United States Patent
Afeyan et al.

(10) Patent No.: US 10,973,861 B2
(45) Date of Patent: Apr. 13, 2021

(54) COMPOSITIONS AND METHODS

(71) Applicant: Seres Therapeutics, Inc., Cambridge, MA (US)

(72) Inventors: Noubar B. Afeyan, Lexington, MA (US); Mary-Jane Lombardo McKenzie, Arlington, MA (US); Kevin Daniel Litcofsky, Boston, MA (US); David N. Cook, Brooklyn, NY (US); Matthew R. Henn, Somerville, MA (US); Geoffrey von Maltzahn, Boston, MA (US)

(73) Assignee: Seres Therapeutics, Inc., Cambridge, MA (US)

( * ) Notice: Subject to any disclaimer, the term of this patent is extended or adjusted under 35 U.S.C. 154(b) by 0 days.

(21) Appl. No.: 14/765,812

(22) PCT Filed: Feb. 4, 2014

(86) PCT No.: PCT/US2014/014747
§ 371 (c)(1),
(2) Date: Aug. 4, 2015

(87) PCT Pub. No.: WO2014/121304
PCT Pub. Date: Aug. 7, 2014

(65) Prior Publication Data
US 2016/0158295 A1 Jun. 9, 2016

Related U.S. Application Data

(60) Provisional application No. 61/760,574, filed on Feb. 4, 2013, provisional application No. 61/760,585, filed on Feb. 4, 2013, provisional application No. 61/760,606, filed on Feb. 4, 2013, provisional application No. 61/760,584, filed on Feb. 4, 2013, provisional application No. 61/798,606, filed on Mar. 15, 2013, provisional application No. 61/926,918, filed on Jan. 13, 2014.

(51) Int. Cl.
| | |
|---|---|
| *A61K 35/744* | (2015.01) |
| *A61K 35/741* | (2015.01) |
| *A61K 35/742* | (2015.01) |
| *A61K 35/00* | (2006.01) |

(52) U.S. Cl.
CPC .......... *A61K 35/744* (2013.01); *A61K 35/741* (2013.01); *A61K 35/742* (2013.01); *A61K 2035/115* (2013.01)

(58) Field of Classification Search
CPC ...... A61K 9/50; A61K 9/5005; A61K 9/5078; A61K 31/397; A61K 2039/52; A61K 2039/54; A61K 2039/545; A61K 2039/55544; A61K 2039/577; A61K 2039/58; A61K 39/02; A61K 39/35; A61K 49/0004; Y02A 50/473; Y02A 50/469; Y02A 50/401; Y02A 50/59; A23L 33/135; A23L 2/52; A23V 2002/00; A23C 9/123; A23C 9/127; A23C 9/13; C12N 2795/00032; C12N 1/20; B01J 2219/00704; B82Y 10/00; B82Y 30/00; B82Y 5/00; C12Q 1/689; G01N 2333/52; G01N 33/54373; G01N 33/6863
See application file for complete search history.

(56) References Cited

U.S. PATENT DOCUMENTS

| | | | |
|---|---|---|---|
| 3,009,861 | A | 11/1961 | Alderton et al. |
| 3,009,864 | A | 11/1961 | Gordon-Aldterton et al. |
| 3,228,838 | A | 1/1966 | Rinfret |
| 3,608,030 | A | 11/1971 | Grant |
| 4,077,227 | A | 3/1978 | Larson |
| 4,205,132 | A | 5/1980 | Sandine |
| 4,655,047 | A | 4/1987 | Temple |
| 4,689,226 | A | 8/1987 | Nurmi |
| 4,839,281 | A | 6/1989 | Gorbach et al. |
| 5,196,205 | A | 3/1993 | Borody |
| 5,425,951 | A | 6/1995 | Goodrich |
| 5,436,002 | A | 7/1995 | Payne |
| 5,443,826 | A | 8/1995 | Borody |
| 5,599,795 | A | 2/1997 | McCann |
| 5,648,206 | A | 7/1997 | Goodrich |
| 5,951,977 | A | 9/1999 | Nisbet et al. |

(Continued)

FOREIGN PATENT DOCUMENTS

| | | |
|---|---|---|
| CN | 102131928 A | 7/2011 |
| EA | 006847 B1 | 4/2006 |

(Continued)

OTHER PUBLICATIONS

Dezfulian, M. et al., "Selective Medium for Isolation of Clostridium botulinum from Human Feces," Journal of Clinical Microbiology, Mar. 1981, pp. 526-531, vol. 13, No. 3.
Dowell, V.R. et al., "Coproexamination for Botulinal Toxin and Clostridium botulinum," JAMA, Oct. 24, 1977, pp. 1829-1832, vol. 238, No. 7.
Gupta, R.K. et al., "Differentiation Between Heat Resistance and Octyl Alcohol Resistance of the Cells of Bacillus Cereus T.," Biochemical and Biophysical Research Communications, 1970, pp. 23-30, vol. 38, No. 1.
Johnston, R. et al., "Method to Facilitate the Isolation of Clostridium botulinum Type E," J. Bacteriol., 1964, pp. 1521-1522, vol. 88.

(Continued)

*Primary Examiner* — Sarvamangala Devi
(74) *Attorney, Agent, or Firm* — Sterne, Kessler, Goldstein & Fox P.L.L.C.

(57) ABSTRACT

Provided are defined bacterial compositions for the maintenance or restoration of a healthy microbiota in the gastrointestinal tract of a mammalian subject, and methods for populating the gastrointestinal tract of a subject. Provided also are bacterial formulations for oral or gastric administration to a mammalian subject in an effective amount for prevention or treatment of a gastrointestinal disease, disorder or condition.

19 Claims, 7 Drawing Sheets
Specification includes a Sequence Listing.

(56) References Cited

U.S. PATENT DOCUMENTS

| | | |
|---|---|---|
| 5,965,128 A | 10/1999 | Doyle et al. |
| 6,589,771 B1 | 7/2003 | Marshall |
| 6,645,530 B1 | 11/2003 | Borody |
| 7,326,551 B2 | 2/2008 | Maupin-Furlow et al. |
| 7,427,398 B2 | 9/2008 | Baillon et al. |
| 7,628,982 B2 | 12/2009 | Klaviniskis |
| 7,632,520 B2 | 12/2009 | Khandelwal |
| 7,708,988 B2 | 5/2010 | Farmer |
| 7,731,976 B2 | 6/2010 | Cobb |
| 7,763,420 B2 | 7/2010 | Stritzker et al. |
| 7,981,411 B2 | 7/2011 | Nadeau et al. |
| 7,998,473 B2 | 8/2011 | Boileau et al. |
| 8,021,654 B2 | 9/2011 | Rehberger et al. |
| 8,034,601 B2 | 10/2011 | Boileau |
| 8,039,006 B2 | 10/2011 | Prato |
| 8,147,482 B2 | 4/2012 | Shimizu |
| 8,187,590 B2 | 5/2012 | Farmer |
| 8,236,508 B2 | 8/2012 | Mutharasan |
| 8,388,996 B2 | 3/2013 | Gehling |
| 8,460,648 B2 | 6/2013 | Borody |
| 8,906,668 B2 | 12/2014 | Henn et al. |
| 8,968,721 B2 | 3/2015 | Harel |
| 9,011,834 B1 | 4/2015 | McKenzie et al. |
| 9,028,841 B2 | 5/2015 | Henn et al. |
| 9,180,147 B2 | 11/2015 | McKenzie et al. |
| 9,408,872 B2 * | 8/2016 | Borody ............... A61K 35/741 |
| 9,446,080 B2 | 9/2016 | McKenzie et al. |
| 9,610,307 B2 | 4/2017 | Berry et al. |
| 9,808,519 B2 | 11/2017 | Honda et al. |
| 2001/0036453 A1 | 11/2001 | Reid |
| 2004/0028689 A1 | 2/2004 | Borody |
| 2004/0170617 A1 | 9/2004 | Finegold |
| 2005/0048515 A1 | 3/2005 | Garner |
| 2005/0180962 A1 | 8/2005 | Raz |
| 2006/0046246 A1 | 3/2006 | Zeng et al. |
| 2006/0067924 A1 | 3/2006 | Lee et al. |
| 2006/0188523 A1 | 8/2006 | Pei |
| 2006/0233830 A1 | 10/2006 | Wong |
| 2007/0141139 A1 | 6/2007 | Vandenberg |
| 2008/0213752 A1 | 9/2008 | Stave et al. |
| 2009/0197249 A1 | 8/2009 | Gillevet |
| 2010/0074872 A1 | 3/2010 | Blaser et al. |
| 2010/0215745 A1 | 8/2010 | Lazzari et al. |
| 2011/0081320 A1 | 4/2011 | Westall et al. |
| 2011/0113863 A1 | 5/2011 | Fuhrmann et al. |
| 2011/0189132 A1 | 8/2011 | Garner et al. |
| 2011/0280840 A1 | 11/2011 | Blaser |
| 2012/0020950 A1 | 1/2012 | Davis et al. |
| 2012/0021429 A1 | 1/2012 | Rublee |
| 2012/0021921 A1 | 1/2012 | Scott |
| 2012/0058094 A1 | 3/2012 | Blaser |
| 2012/0064592 A1 | 3/2012 | O'Mullan et al. |
| 2012/0128633 A1 | 5/2012 | Veiga et al. |
| 2012/0128634 A1 | 5/2012 | Veiga |
| 2012/0148629 A1 | 6/2012 | Holvoet et al. |
| 2012/0149584 A1 | 6/2012 | Olle |
| 2012/0165215 A1 | 6/2012 | Andersen |
| 2012/0177650 A1 | 7/2012 | Borody |
| 2012/0207726 A1 | 8/2012 | Lipkin |
| 2012/0238468 A1 | 9/2012 | Tuk |
| 2012/0264637 A1 | 10/2012 | Brodie |
| 2012/0276149 A1 | 11/2012 | Littman |
| 2012/0276201 A1 | 11/2012 | Trachtman |
| 2012/0315249 A1 | 12/2012 | Olmstead |
| 2013/0017999 A1 | 1/2013 | Fremont |
| 2013/0022575 A1 | 1/2013 | Cassity |
| 2013/0045274 A1 | 2/2013 | Hlavka |
| 2013/0045874 A1 | 2/2013 | Ehrlich |
| 2013/0121968 A1 | 5/2013 | Quay |
| 2013/0149339 A1 | 6/2013 | Honda |
| 2013/0149375 A1 | 6/2013 | Geall |
| 2013/0266539 A1 | 10/2013 | Borody |
| 2014/0045744 A1 | 2/2014 | Gordon |
| 2014/0147417 A1 | 5/2014 | Sadowsky et al. |
| 2014/0147425 A1 | 5/2014 | Henn et al. |
| 2014/0199281 A1 | 7/2014 | Henn et al. |
| 2014/0342438 A1 * | 11/2014 | Allen-Vercoe ............ C12N 1/20 435/252.4 |
| 2015/0093360 A1 | 4/2015 | McKenzie et al. |
| 2015/0190435 A1 | 7/2015 | Henn et al. |
| 2016/0271188 A1 | 9/2016 | Berry et al. |
| 2017/0165302 A1 | 6/2017 | Henn et al. |

FOREIGN PATENT DOCUMENTS

| | | |
|---|---|---|
| EP | 0033584 A3 | 1/1981 |
| EP | 0446069 A1 | 9/1991 |
| EP | 0456418 A2 | 11/1991 |
| EP | 0433299 A4 | 4/1992 |
| EP | 1107772 B1 | 4/2006 |
| EP | 1631312 B1 | 9/2008 |
| EP | 2337569 A2 | 6/2011 |
| EP | 2338989 A1 | 6/2011 |
| EP | 2519108 A1 | 11/2012 |
| EP | 2684469 A1 | 1/2014 |
| EP | 0479820 B1 | 7/2014 |
| EP | 2626076 A1 | 8/2014 |
| EP | 2750682 B1 | 5/2016 |
| JP | 6-56679 A | 3/1994 |
| JP | 2007-332083 A | 12/2007 |
| JP | 2010-539179 T | 12/2010 |
| JP | 5 019563 B2 | 9/2012 |
| RU | 2035186 C1 | 5/1995 |
| RU | 2439145 C2 | 1/2012 |
| WO | WO 90/01335 A1 | 2/1990 |
| WO | WO 1997/009886 A1 | 3/1997 |
| WO | WO 98/26787 A1 | 6/1998 |
| WO | WO 2000/010582 A2 | 3/2000 |
| WO | WO 01/93904 A1 | 12/2001 |
| WO | WO 2002/007741 A1 | 1/2002 |
| WO | WO 02/43649 A2 | 6/2002 |
| WO | WO 2005/017095 A2 | 2/2005 |
| WO | WO 2005/110445 A2 | 11/2005 |
| WO | WO 2006/012586 A2 | 2/2006 |
| WO | WO 2007/036230 A1 | 4/2007 |
| WO | WO 2007/136553 A2 | 11/2007 |
| WO | WO 2008/076696 A2 | 6/2008 |
| WO | WO 2008/083157 A2 | 7/2008 |
| WO | WO 2010/030997 A1 | 3/2010 |
| WO | WO 2010/062369 A2 | 6/2010 |
| WO | WO 2010/124387 A1 | 11/2010 |
| WO | WO 2010/151842 A2 | 12/2010 |
| WO | WO 2011/005756 A1 | 1/2011 |
| WO | WO 2011/022542 A2 | 2/2011 |
| WO | WO 2011022660 A1 | 2/2011 |
| WO | WO 2011/033310 A1 | 3/2011 |
| WO | WO 2011/043654 A1 | 4/2011 |
| WO | WO 2011/046616 A3 | 4/2011 |
| WO | WO 2011/060123 A1 | 5/2011 |
| WO | WO 2011/094027 A1 | 8/2011 |
| WO | WO 2011/103123 A2 | 8/2011 |
| WO | WO 2011/107482 A2 | 9/2011 |
| WO | WO 2011/113801 A1 | 9/2011 |
| WO | WO 2011107481 A2 | 9/2011 |
| WO | WO 2011/152566 A2 | 12/2011 |
| WO | WO 2012/009712 A2 | 1/2012 |
| WO | WO 2012/016287 A2 | 2/2012 |
| WO | WO 2012/033814 A2 | 3/2012 |
| WO | WO 2012/045150 A1 | 4/2012 |
| WO | WO 2012/064981 A2 | 5/2012 |
| WO | WO 2012/108830 A1 | 8/2012 |
| WO | WO 2012/116289 A2 | 8/2012 |
| WO | WO 2012/122478 A1 | 9/2012 |
| WO | WO 2012/122522 A2 | 9/2012 |
| WO | WO 2012/142605 A2 | 10/2012 |
| WO | WO 2012/148991 A1 | 11/2012 |
| WO | WO 2012/159023 A2 | 11/2012 |
| WO | WO 2013/019896 A1 | 2/2013 |
| WO | WO 2013/032328 A1 | 3/2013 |
| WO | WO 2013/037067 A1 | 3/2013 |
| WO | WO 2013/037068 A1 | 3/2013 |
| WO | WO 2013/050792 A1 | 4/2013 |
| WO | WO 2013/053836 A1 | 4/2013 |
| WO | WO 2013/080561 A1 | 6/2013 |

(56) References Cited

FOREIGN PATENT DOCUMENTS

| | | |
|---|---|---|
| WO | WO 2013/166031 A1 | 11/2013 |
| WO | WO 2013/171515 A1 | 11/2013 |
| WO | WO 2013/176774 A1 | 11/2013 |
| WO | WO 2014/082050 A1 | 5/2014 |
| WO | WO 2015/095241 A2 | 6/2014 |
| WO | WO 2014/121298 A2 | 8/2014 |
| WO | WO 2014/121301 A1 | 8/2014 |
| WO | WO 2014/121302 A2 | 8/2014 |
| WO | WO 2014/121304 A1 | 8/2014 |
| WO | WO 2014/145958 A2 | 9/2014 |
| WO | WO 2014/153194 A2 | 9/2014 |
| WO | WO 2015/077794 A1 | 5/2015 |
| WO | WO 2017/091783 A2 | 6/2017 |
| WO | WO 2017/160711 A1 | 9/2017 |
| WO | WO 2019/089643 A1 | 5/2019 |

OTHER PUBLICATIONS

Naaber P. et al., "Inhibition of Clostridium difficile Strains by Intestinal *Lactobacillus* Species" Journal of Medical Microbiology, 2004, pp. 551-554, vol. 53.
New Zealand Examination Report, New Zealand Application No. 709392, dated Jun. 9, 2016, 7 pages.
Russell, A.D., "The Destruction of Bacterial Spores," 1982, pp. 191-193.
Aas, J., Gessert, C.E., and Bakken, J.S. (2003). Recurrent Clostridium difficile colitis: case series involving 18 patients treated with donor stool administered via a nasogastric tube. Clinical Infectious Diseases 36(5), 580-585.
Abrams, R.S., "Open-Label, Uncontrolled Trial of Bowel Sterilization and Repopulation with Normal Bowel Flora for Treatment of Inflammatory Bowel Disease," Current Therapeutic Research, Dec. 1997, pp. 1001-1012, vol. 58, No. 12.
Achtman, M., and Wagner, M. (2008). Microbial diversity and the genetic nature of microbial species. Nat. Rev. Microbiol. 6(6), 431-440.
Accoceberry, I. et al., "One-Step Purification of Enterocytozoon Bieneusi Spores from Human Stools by Immunoaffinity Expanded-Bed Adsorption," Journal of Clinical Microbiology, May 2001, pp. 1974-1951, vol. 39, No. 5.
Allen-Vercoe, E., Reid, G., Viner, N., Gloor, G.B., Hota, S., Kim, P., Lee, C., O'Doherty, K., Vanner, S.J., Weese, J.S., et al. (2012). A Canadian Working Group report on fecal microbial therapy: microbial ecosystems therapeutics. Can. J. Gastroenterol. 26(7), 457-462.
Allen-Vercoe, E., Strauss, J., and Chadee, K. (2011). Fusobacterium nucleatum: an emerging gut pathogen? Gut Microbes 2(5), 294-298.
Anderson, K.F., Lonsway, D.R., Rasheed, J.K., Biddle, J., Jensen, B., McDougal, L.K., Carey, R.B., Thompson, A., Stocker, S., Limbago, B., et al. (2007). Evaluation of Methods to Identify the Klebsiella pneumoniae Carbapenemase in Enterobacteriaceae. J. Clin. Microbiol. 45(8), 2723-2725.
Arumugam, M., Raes, J., Pelletier, E., Paslier, D.L., Yamada, T., Mende, D.R., Fernandes, G.R., Tap, J., Bruls, T., Batto, J.-M., et al. (2011). Enterotypes of the human gut microbiome. Nature 473(7346), 174-180.
Atarashi, K., Tanoue, T., Oshima, K., Suda, W., Nagano, Y., Nishikawa, H., Fukuda, S., Saito, T., Narushima, S., Hase, K., et al. (2013). Treg induction by a rationally selected mixture of Clostridia strains from the human microbiota. Nature 500(7461), 232-236.
Atarashi, K., Tanoue, T., Shima, T., Imaoka, A., Kuwahara, T., Momose, Y., Cheng, G., Yamasaki, S., Saito, T., Ohba, Y., et al. (2011). Induction of colonic regulatory T cells by indigenous *Clostridium* species. Science 331(6015), 337-341.
Backhed, F. et al., (2004). The gut microbiota as an environmental factor that regulates fat storage, PNAS, Nov. 2, 2014, pp. 15718-15723, vol. 101, No. 44.
Bader, J., Albin, A., and Stahl, U. (2012). Spore-forming bacteria and their utilisation as probiotics. Benef Microbes 3(1), 67-75.
Bakken, J.S. (2009). Fecal bacteriotherapy for recurrent Clostridium difficile infection. Anaerobe 15(6), 285-289.

Bakken, J.S., Borody, T., Brandt, L.J., Brill, J.V., Demarco, D.C., Franzos, M.A., Kelly, C., Khoruts, A., Louie, T., Martinelli, L.P., et al. (2011). Treating Clostridium difficile infection with fecal microbiota transplantation. Clin. Gastroenterol. Hepatol. 9(12), 1044-1049.
Barreau, M., Pagnier, I., and La Scola, B. (2013). Improving the identification of anaerobes in the clinical microbiology laboratory through MALDI-TOF mass spectrometry. Anaerobe 22,123-125.
Bauer, T.M. et al., "Derivation and Validation of Guidelines for Stool Cultures for Enteropathogenic Bacteria Other Than Clostridium difficile in Hospitalized Adults," The Journal of the American Medical Association, Jan. 17, 2001, pp. 313-319, vol. 285.
Ben-Amor, K., Heilig, H., Smidt, H., Vaughan, E.E., Abee, T., and De Vos, W.M. (2005). Genetic diversity of viable, injured, and dead fecal bacteria assessed by fluorescence-activated cell sorting and 16S rRNA gene analysis. Applied and Environmental Microbiology 71(8), 4679-4689.
Berstad, A. et al., "Fecal Fat Determination with a Modified Titration Method," Scandinavian Journal of Gastroenterology, 2010, pp. 603-607, vol. 45.
Bhatia, A. et al., "Proionibacterium Acnes and Chronic Diseases," The Infectious Etiology of Chronic Diseases: Defining the Relationship, Enhancing the Research, and Mitigating the Effects: Workshop Summary., Knobler, S.L. et al. (eds.), 2004, pp. 74-80, may be downloaded at<URL:http://www.nap.edu/catalog/11026.html>.
Bidawid, S., Farber, J.M., Sattar, S.A., and Hayward, S. (2000). Heat inactivation of hepatitis A virus in dairy foods. J. Food Prot. 63(4), 522-528.
Bloedt, K., Riecker, M., Poppert, S., and Wellinghausen, N. (2009). Evaluation of new selective culture media and a rapid fluorescence in situ hybridization assay for identification of Clostridium difficile from stool samples. J Med Microbiol 58(7), 874-877.
Bokulich, N.A., Subramanian, S., Faith, J.J., Gevers, D., Gordon, J.I., Knight, R., Mills, D.A., and Caporaso, J.G. (2013). Quality-filtering vastly improves diversity estimates from Illumina amplicon sequencing. Nat Methods 10(1), 57-59.
Bolivar, I. et al., "Bacterial Diversity in Oral Samples of Children in Niger with Acute Noma, Acute Necrotizing Gingivitis and Healthy Controls," PLOS Neglected Tropical Diseases, Mar. 2012, pp. 1-11, vol. 6, No. 3, E1556; Uncultured *Catonella* sp. partial 16S rRNA Gene, Clone 402A04(oral): Nucleotide: NCBi: GenBank: AM420133.1, last accessed Mar. 12, 2014, pp. 12-13.
Borody, T.J. et al. (2011). Fecal microbiota transplantation (FMT) in multiple sclerosis. Poster abstract at American College of Gastroenterology Annual Scientific Meeting and Postgraduate Course Oct. 28 2011.
Borody, T.J., and Khoruts, A. (2012). Fecal microbiota transplantation and emerging applications. Nat Rev Gastroenterol Hepatol 9(2), 88-96.
Borriello, S.P. (1990). The influence of the normal flora on Clostridium difficile colonisation of the gut. Ann. Med. 22(1), 61-67.
Borriello, S.P., and Barclay, F.E. (1985). Protection of hamsters against Clostridium difficile ileocaecitis by prior colonisation with non-pathogenic strains. J Med Microbiol 19(3), 339-350.
Borriello, S.P., and Barclay, F.E. (1986). An in-vitro model of colonisation resistance to Clostridium difficile infection. Journal of Medical Microbiology 21(4), 299-309.
Borriello, S.P., and Honour, P. (1981). Simplified procedure for the routine isolation of Clostridium difficile from faeces. J Clin Pathol 34(10), 1124-1127.
Boyles, W.A., and Lincoln, R.E. (1958). Separation and concentration of bacterial spores and vegetative cells by foam flotation. Appl Microbiol 6(5), 327-334.
Brandt, L.J. (2012). Fecal Transplantation for the Treatment of Clostridium difficile Infection. Gastroenterol Hepatol (N Y) 8(3), 191-194.
Brandt, L.J., Aroniadis, O.C., Mellow, M., Kanatzar, A., Kelly, C., Park, T., Stollman, N., Rohlke, F., and Surawicz, C. (2012). Long-Term Follow-Up of Colonoscopic Fecal Microbiota Transplant for Recurrent Clostridium difficile Infection. The American Journal of Gastroenterology 107(7), 1079-1087.

(56) References Cited

OTHER PUBLICATIONS

Bräuniger, S., Peters, J., Borchers, U., and Kao, M. (2000). Further studies on thermal resistance of bovine parvovirus against moist and dry heat. International Journal of Hygiene and Environmental Health 203(1), 71-75.
Broda, D.M., De Lacy, K.M., and Bell, R.G. (1998). Efficacy of heat and ethanol spore treatments for the isolation of psychrotrophic *Clostridium* spp. associated with the spoilage of chilled vacuum-packed meats. International Journal of Food Microbiology 39(1-2), 61-68.
Brosius, J. et al., "Complete Nucleotide Sequence of a 16S Ribosomal RNA Gene from *Eschericia coli*," Proc. Natl. Acad. Sci., Oct. 1978, pp. 4801-4805, vol. 75, No. 10.
Bueche, M., Wunderlin, T., Roussel-Delif, L., Junier, T., Sauvain, L., Jeanneret, N., and Junier, P. (2013). Quantification of Endospore-Forming Firmicutes by Quantitative PCR with the Functional Gene spo0A. Applied and Environmental Microbiology 79(17), 5302-5312.
Buffie, C.G., and Pamer, E.G. (2013). Microbiota-mediated colonization resistance against intestinal pathogens. Nature Reviews Immunology 13(11), 790-801.
Burke, C.J., Hsu, T.A., and Volkin, D.B. (1999). Formulation, stability, and delivery of live attenuated vaccines for human use. Crit Rev Ther Drug Carrier Syst 16(1), 1-83.
Cani, P.D., Possemiers, S., Wiele, T.V. De, Guiot, Y., Everard, A., Rottier, O., Geurts, L., Naslain, D., Neyrinck, A., Lambert, D.M., et al. (2009). Changes in gut microbiota control inflammation in obese mice through a mechanism involving GLP-2-driven improvement of gut permeability. Gut 58(8), 1091-1103.
Carvalho, A.S., Silva, J., Ho, P., Teixeira, P., Malcata, F.X., and Gibbs, P. (2008). Effects of Various Sugars Added to Growth and Drying Media upon Thermotolerance and Survival throughout Storage of Freeze-Dried *Lactobacillus delbrueckii* ssp. bulgaricus. Biotechnology Progress 20(1), 248-254.
Champagne, C.P., Mondou, F., Raymond, Y., and Roy, D. (1996). Effect of polymers and storage temperature on the stability of freeze-dried lactic acid bacteria. Food Research International 29(5-6), 555-562.
Chang, J.Y., Antonopoulos, D.A., Kalra, A., Tonelli, A., Khalife, W.T., Schmidt, T.M., and Young, V.B. (2008). Decreased diversity of the fecal Microbiome in recurrent Clostridium difficile-associated diarrhea. J. Infect. Dis. 197(3), 435-438.
Chapman, C.M.C., Gibson, G.R., and Rowland, I. (2012). In vitro evaluation of single- and multi-strain probiotics: Inter-species inhibition between probiotic strains, and inhibition of pathogens. Anaerobe 18(4), 405-413.
Chen, X., Katchar, K., Goldsmith, J.D., Nanthakumar, N., Cheknis, A., Gerding, D.N., and Kelly, C.P. (2008). A Mouse Model of Clostridium difficile—Associated Disease. Gastroenterology 135(6), 1984-1992.
Chow, J., Tang, H., and Mazmanian, S.K. (2011). Pathobionts of the Gastrointestinal Microbiota and Inflammatory Disease. Curr Opin Immunol 23(4), 473-480.
Claesson, M.J., Wang, Q., O'Sullivan, O., Greene-Diniz, R., Cole, J.R., Ross, R.P., and O'Toole, P.W. (2010). Comparison of two next-generation sequencing technologies for resolving highly complex microbiota composition using tandem variable 16S rRNA gene regions. Nucleic Acids Res 38(22), e200.
Clemente, J.C., Ursell, L.K., Parfrey, L.W., and Knight, R. (2012). The impact of the gut microbiota on human health: an integrative view. Cell 148(6), 1258-1270.
D'Souza, D.H., and Su, X. (2010). Efficacy of chemical treatments against murine norovirus, feline calicivirus, and MS2 bacteriophage. Foodborne Pathogens and Disease 7(3), 319-326.
David, L.A., Maurice, C.F., Carmody, R.N., Gootenberg, D.B., Button, J.E., Wolfe, B.E., Ling, A.V., Devlin, A.S., Varma, Y., Fischbach, M.A., et al. (2013). Diet rapidly and reproducibly alters the human gut microbiome. Nature advance online publication.
De Angelis, M., Piccolo, M., Vannini, L., Siragusa, S., De Giacomo, A., Serrazzanetti, D.I., Cristofori, F., Guerzoni, M.E., Gobbetti, M., and Francavilla, R. (2013). Fecal Microbiota and Metabolome of Children with Autism and Pervasive Developmental Disorder Not Otherwise Specified. PLoS One 8(10), e76993.
De Vos, W.M. (2013). Fame and future of faecal transplantations—developing next-generation therapies with synthetic microbiomes: Fame and future of faecal transplantations. Microbial Biotechnology 6(4), 316-325.
Defined Fecal Microbiota Transplantation for Clostridium Difficile Diarrhea <http://clinicaltrials.gov/ct2/show/NCT01868373> Accessed Mar. 26, 2014.
Derrien, M. (2004). *Akkermansia muciniphila* gen. nov., sp. nov., a human intestinal mucin-degrading bacterium. International Journal of Systematic and Evolutionary Microbiology 54(5), 1469-1476.
Dethlefsen, L., Huse, S., Sogin, M.L., and Relman, D.A. (2008). The Pervasive Effects of an Antibiotic on the Human Gut Microbiota, as Revealed by Deep 16S rRNA Sequencing. PLoS Biology 6(11), e280.
Detmer, A., and Glenting, J. (2006). Live bacterial vaccines—a review and identification of potential hazards. Microb Cell Fact 5, 23.
Dharmani, P., De Simone, C., and Chadee, K. (2013). The Probiotic Mixture VSL#3 Accelerates Gastric Ulcer Healing by Stimulating Vascular Endothelial Growth Factor. PLoS One 8(3), e58671.
Dietrich, G., Collioud, A., and Rothen, S.A. (2008). Developing and Manufacturing Attenuated Live Bacterial Vaccines. <http://www.biopharminternational.com/biopharm/Vaccine+Manufacturing+Articles/Developing-and-Manufacturing-Attenuated-Live-Bacte/ArticleStandard/Article/detail/557306> Accessed Mar. 25, 2014.
Dragon, D.C., and Rennie, R.P. (2001). Evaluation of spore extraction and purification methods for selective recovery of viable Bacillus anthracis spores. Lett. Appl. Microbiol. 33(2), 100-105.
Duc, L. (2003). Germination of the spore in the gastrointestinal tract provides a novel route for heterologous antigen delivery. Vaccine 21(27-30), 4215-4224.
Duc, L.H., Hong, H.A., Fairweather, N., Ricca, E., and Cutting, S.M. (2003). Bacterial Spores as Vaccine Vehicles. Infection and Immunity 71(5), 2810-2818.
Dumas, M.E. et al., (2006). Metabolic profiling reveals a contribution of gut microbiota to fatty liver phenotype in insulin-resistant mice, PNAS, Aug. 15, 2006, pp. 12511-12516, vol. 103, No. 33.
Dutta, S.K., Girotra, M., Garg, S., Dutta, A., Von Rosenvinge, E.C., Maddox, C., Song, Y., Bartlett, J.G., Vinayek, R., and Fricke, W.F. (2014). Efficacy of Combined Jejunal and Colonic Fecal Microbiota Transplantation for Recurrent Clostridium difficile Infection. Clinical Gastroenterology and Hepatology.
Edwards, A.D., and Slater, N.K.H. (2008). Formulation of a live bacterial vaccine for stable room temperature storage results in loss of acid, bile and bile salt resistance. Vaccine 26(45), 5675-5678.
Eiseman, B., Silen, W., Bascom, G.S., and Kauvar, A.J. (1958). Fecal enema as an adjunct in the treatment of pseudomembranous enterocolitis. Surgery 44(5), 854-859.
Elving, J., Emmoth, E., Albihn, A., Vinneras, B., and Ottoson, J. (2012). Composting for Avian Influenza Virus Elimination. Applied and Environmental Microbiology 78(9), 3280-3285.
Emanuelsson, F., Claesson, B.E.B., Ljungström, L., Tvede, M., and Ung, K.-A. (2014). Faecal microbiota transplantation and bacteriotherapy for recurrent Clostridium difficile infection: A retrospective evaluation of 31 patients. Scandinavian Journal of Infectious Diseases 46(2), 89-97.
Endt, K., Stecher, B., Chaffron, S., Slack, E., Tchitchek, N., Benecke, A., Van Maele, L., Sirard, J.-C., Mueller, A.J., Heikenwalder, M., et al. (2010). The Microbiota Mediates Pathogen Clearance from the Gut Lumen after Non-Typhoidal *Salmonella* Diarrhea. PLoS Pathog 6(9), e1001097.
Everard, A., Belzer, C., Geurts, L., Ouwerkerk, J.P., Druart, C., Bindels, L.B., Guiot, Y., Derrien, M., Muccioli, G.G., Delzenne, N.M., et al. (2013). Cross-talk between Akkermansia muciniphila and intestinal epithelium controls diet-induced obesity. Proceedings of the National Academy of Sciences 110(22), 9066-9071.
Fairhead, H., Setlow, B., Waites, W.M., and Setlow, P. (1994). Small, acid-soluble proteins bound to DNA protect Bacillus subtilis spores from being killed by freeze-drying. Applied and Environmental Microbiology 60(7), 2647-2649.

(56) References Cited

OTHER PUBLICATIONS

Faith, J.J., Ahern, P.P., Ridaura, V.K., Cheng, J., and Gordon, J.I. (2014). Identifying Gut Microbe—Host Phenotype Relationships Using Combinatorial Communities in Gnotobiotic Mice. Sci Transl Med 6(220), 220ra11-220ra11.

Fakhry, S., Sorrentini, I., Ricca, E., De Felice, M., and Baccigalupi, L. (2008). Characterization of spore forming Bacilli isolated from the human gastrointestinal tract. Journal of Applied Microbiology 105(6), 2178-2186.

Faust, et al., "Microbial Co-occurrence Relationships in the Human Microbiome," PLoS Computational Biology, Jul. 2012, e1002606, 17 pages, vol. 8, No. 7.

Fell Jr., N.F., Pellegrino, P.M., and Gillespie, J.B. (2001). Mitigating phosphate interference in bacterial endospore detection by Tb dipicolinate photoluminescence. Analytica Chimica Acta 426(1), 43-50.

Fichtel, J., Köster, J., Rullkötter, J., and Sass, H. (2007). Spore dipicolinic acid contents used for estimating the Number of endospores in sediments. FEMS Microbiology Ecology 61(3), 522-532.

Fischbach, M.A., Bluestone, J.A., and Lim, W.A. (2013). Cell-Based Therapeutics: The Next Pillar of Medicine. Sci Transl Med 5(179), 179ps7.

Fonseca, F., Béal, C., and Corrieu, G. (2001). Operating Conditions That Affect the Resistance of Lactic Acid Bacteria to Freezing and Frozen Storage. Cryobiology 43(3), 189-198.

Franz, C.M.A.P., Huch, M., Abriouel, H., Holzapfel, W., and Gálvez, A. (2011). Enterococci as probiotics and their implications in food safety. International Journal of Food Microbiology 151(2), 125-140.

Friedman-Moraco, R.J., Mehta, A.K., Lyon, G.M., and Kraft, C.S. (2014). Fecal Microbiota Transplantation for Refractory Clostridium difficile Colitis in Solid Organ Transplant Recipients: Fecal Microbiota Transplantation in Solid Organ Transplant Recipients. American Journal of Transplantation 14(2), 477-480.

Fuentes, S., Van Nood, E., Tims, S., Heikamp-De Jong, I., Ter Braak, C.J., Keller, J.J., Zoetendal, E.G., and De Vos, W.M. (2014). Reset of a critically disturbed microbial ecosystem: faecal transplant in recurrent Clostridium difficile infection. The ISME Journal.

GenBank HQ819637, "Uncultured Organism Clone ELU0180-T56-S-NIPCRAMgANa_000311 Small Subunit Ribosomal RNA Gene, Partial Sequence," Jul. 30, 2012,1 page, [Online] [Retrieved on Aug. 21, 2014] Retrieved from the Internet<URL:http://www.ncbi.nlm.nih.gov/nuccore/HQ819637>.

Gevers, D., Kugathasan, S., Denson, L.A., Vázquez-Baeza, Y., Van Treuren, W., Ren, B., Schwager, E., Knights, D., Song, S.J., Yassour, M., et al. (2014). The Treatment-Naive Microbiome in New-Onset Crohn's Disease. Cell Host & Microbe 15(3), 382-392.

Gilligan, P.H. (2013). Identification of Pathogens by Classical Clinical Tests. In the Prokaryotes, E. Rosenberg, E.F. DeLong, S. Lory, E. Stackebrandt, and F. Thompson, eds. (Springer Berlin Heidelberg), pp. 57-89.

Goodman, A.L., Kallstrom, G., Faith, J.J., Reyes, A., Moore, A., Dantas, G., and Gordon, J.I. (2011). From the Cover: Extensive personal human gut microbiota culture collections characterized and manipulated in gnotobiotic mice. Proceedings of the National Academy of Sciences 108(15), 6252-6257.

Goodman, N.S., Gottfried, R.J., and Rogoff, M.H. (1967). Biphasic system for separation of spores and crystals of Bacillus thuringiensis. Journal of Bacteriology 94(2), 485.

Gough, E. et al., "Systematic Review of Intestinal Microbiota Transplantation (Fecal Bacteriotherapy) for Recurrent Clostridium Dfficile Infection," Clin. Infect. Dis., Nov. 15, 2011, pp. 994-1002, vol. 53, No. 10.

Gould, G.W., and Sale, A.J. (1970). Initiation of germination of bacterial spores by hydrostatic pressure. J. Gen. Microbiol. 60(3), 335-346.

Grabow, W.O., Clay, C.G., Dhaliwal, W., Vrey, M.A., and Müller, E.E. (1999). Elimination of viruses, phages, bacteria and Cryptosporidium by a new generation Aquaguard point-of-use water treatment unit. Zentralbl Hyg Umweltmed 202(5), 399-410.

Greenway, F., Wang, S., and Heiman, M. (2014). A novel cobiotic containing a prebiotic and an antioxidant augments the glucose control and gastrointestinal tolerability of metformin: a case report. Beneficial Microbes 5(1), 29-32.

Grehan, M.J., Borody, T.J., Leis, S.M., Campbell, J., Mitchell, H., and Wettstein, A. (2010). Durable alteration of the colonic microbiota by the administration of donor fecal flora. J. Clin. Gastroenterol. 44(8), 551-561.

Grimoud, J. et al., "In Vitro Screening of Probiotic Lactic Acid Bacteria and Prebiotic Glucooligosaccharides to Select Effective Synbiotics," Anaerobe, Clinical Microbiology, Oct. 2010, pp. 493-500, vol. 16, No. 5.

Hamilton, M.J., Weingarden, A.R., Sadowsky, M.J., and Khoruts, A. (2012). Standardized frozen preparation for transplantation of fecal microbiota for recurrent Clostridium difficile infection. Am. J. Gastroenterol. 107(5), 761-767.

Hamilton, M.J., Weingarden, A.R., Unno, T., Khoruts, A., and Sadowsky, M.J. (2013). High-throughput DNA sequence analysis reveals stable engraftment of gut microbiota following transplantation of previously frozen fecal bacteria. Gut Microbes 4(2), 125-135.

Harmsen, H. J. M., Gibson, G. R., Elfferich, P., Raangs, G. C., Wildeboer-Veloo, A. C. M., Argaiz, A., Roberfroid, M. B., and Welling, G. W. (2000). Comparison of viable cell counts and fluorescence in situ hybridization using specific rRNA-based probes for the quantification of human fecal bacteria. FEMS Microbiology Letters 183(1), 125-129.

Harrison, F., "Bacterial Cooperation in the Wild and in the Clinic: Are Pathogen Social Behaviours Relevant Outside the Laboratory?" Bioessays, Dec. 27, 2012, pp. 108-112, vol. 35, No. 2.

Hasan, J.A., Japal, K.M., Christensen, E.R., and Samalot-Freire, L.C. (2011). In vitro production of Clostridium difficile spores for use in the efficacy evaluation of disinfectants: a precollaborative investigation. J AOAC Int 94(1), 259-272.

Hayashi, Y. et al., "Western Blot (Immunoblot) Assay of Small Round-Structured Virus Associated with an Acute Gastroenteritis Outbreak in Tokyo," Journal of Clinical Microbiology, Aug. 1989, pp. 1728-1733, vol. 27.

Hell, M., Bernhofer, C., Stalzer, P., Kern, J.M., and Claassen, E. (2013). Probiotics in Clostridium difficile infection: reviewing the need for a multistrain probiotic. Beneficial Microbes 4(1), 39-51.

Hemmerling, A., Harrison, W., Schroeder, A., Park, J., Korn, A., Shiboski, S., Foster-Rosales, A., and Cohen, C.R. (2010). Phase 2a Study Assessing Colonization Efficiency, Safety, and Acceptability of Lactobacillus crispatus CTV-05 in Women With Bacterial Vaginosis: Sexually Transmitted Diseases 37(12), 745-750.

Herron, P.R., and Wellington, E.M.H. (1990). New Method for Extraction of Streptomycete Spores from Soil and Application to the Study of Lysogeny in Sterile Amended and Nonsterile Soil. Appl Environ Microbiol 56(5), 1406-1412.

Hewitt, J., Rivera-Aban, M., and Greening, G.E. (2009). Evaluation of murine norovirus as a surrogate for human norovirus and hepatitis A virus in heat inactivation studies. Journal of Applied Microbiology 107(1), 65-71.

Hindle, A.A., and Hall, E.A.H. (1999). Dipicolinic acid (DPA) assay revisited and appraised for spore detection. The Analyst 124(11), 1599-1604.

Hirsch, E.B., and Tam, V.H. (2010). Detection and treatment options for Klebsiella pneumoniae carbapenemases (KPCs): an emerging cause of multidrug-resistant infection. J. Antimicrob. Chemother. 65(6), 1119-1125.

Hofsten, B.V. (1966). Partition of *Escherichia coli* in an aqueous polymer two-phase system. Experimental Cell Research 41(1), 117-123.

Holmes, E., Kinross, J., Gibson, G.R., Burcelin, R., Jia, W., Pettersson, S., and Nicholson, J.K. (2012). Therapeutic Modulation of Microbiota-Host Metabolic Interactions. Science Translational Medicine 4(137), 137rv6-137rv6.

Hoppe, B., Groothoff, J.W., Hulton, S.-A., Cochat, P., Niaudet, P., Kemper, M.J., Deschênes, G., Unwin, R., and Milliner, D. (2011). Efficacy and safety of Oxalobacter formigenes to reduce urinary oxalate in primary hyperoxaluria. Nephrol. Dial. Transplant. 26(11), 3609-3615.

(56) References Cited

OTHER PUBLICATIONS

Hoyles, L., Honda, H., Logan, N.A., Halket, G., La Ragione, R.M., and Mccartney, A.L. (2012). Recognition of greater diversity of *Bacillus* species and related bacteria in human faeces. Res. Microbiol. 163(1), 3-13.

Hurst, C.J., and Gerba, C.P. (1989). Fate of viruses during wastewater sludge treatment processes. Critical Reviews in Environmental Control 18(4), 317-343.

Iizuka, M. et al., "Elemental Diet Modulates the Growth of Clostridium difficile in the Gut Flora," Aliment Pharmacol. Ther., Jul. 2004, pp. 151-157, vol. 20, Suppl. 1.

Itoh, K., and Mitsuoka, T. (1985). Characterization of clostridia isolated from faeces of limited flora mice and their effect on caecal size when associated with germ-free mice. Laboratory Animals 19(2), 111-118.

Itoh, K., Lee, W.K., Kawamura, H., Mitsuoka, T., and Magaribuchi, T. (1987). Intestinal bacteria antagonistic to Clostridium difficile in mice. Lab Anim 21(1), 20-25.

Itoh, K., Urano, T., and Mitsuoka, T. (1986). Colonization resistance against Pseudomonas aeruginosa in gnotobiotic mice. Lab Anim 20(3), 197-201.

Jalanka-Tuovinen, J., Salojarvi, J., Salonen, A., Immonen, O., Garsed, K., Kelly, F.M., Zaitoun, A., Palva, A., Spiller, R.C., and De Vos, W.M. (2013). Faecal microbiota composition and host-microbe cross-talk following gastroenteritis and in postinfectious irritable bowel syndrome. Gut 0, 1-9.

Jeffs, L.B., and Khachatourians, G.G. (1997). Estimation of spore hydrophobicity for members of the genera Beauveria, Metarhizium, and Tolypocladium by salt-mediated aggregation and sedimentation. Canadian Journal of Microbiology 43(1), 23-28.

Jensen, N.S., and Canale-Parola, E. (1986). *Bacteroides pectinophilus* sp. nov. and *Bacteroides galacturonicus* sp. nov.: two pectinolytic bacteria from the human intestinal tract. Appl. Environ. Microbiol. 52(4), 880-887.

Jones, M.L., Martoni, C.J., and Prakash, S. (2012a). Cholesterol lowering and inhibition of sterol absorption by Lactobacillus reuteri NCIMB 30242: a randomized controlled trial. EurJ Clin Nutr 66(11), 1234-1241.

Jones, M.L., Martoni, C.J., Parent, M., and Prakash, S. (2012b). Cholesterol-lowering efficacy of a microencapsulated bile salt hydrolase-active Lactobacillus reuteri NCIMB 30242 yoghurt formulation in hypercholesterolaemic adults. British Journal of Nutrition 107(10), 1505-1513.

Jorgensen, J.H., and Ferraro, M.J. (2009). Antimicrobial Susceptibility Testing: A Review of General Principles and Contemporary Practices. Clin Infect Dis., Medical Microbiology, 49(11), 1749-1755.

Jorup-Rönström, C., Hakanson, A., Sandell, S., Edvinsson, O., Midtvedt, T., Persson, A.-K., and Norin, E. (2012). Fecal transplant against relapsing Clostridium difficile-associated diarrhea in 32 patients. Scand. J. Gastroenterol. 47(5), 548-552.

Jousimies-Somer, H., Summanen, P., Citron, D.M., Baron, E.J., Wexler, H.M., and Finegold, S.M. (2002). Wadsworth-KLT Anaerobic Bacteriology Manual, 6th edition (California: Star), pp. 55-74, 81-132, 165-185.

Kailasapathy, K. (2002). Microencapsulation of probiotic bacteria: technology and potential applications. Curr Issues Intest Microbiol 3(2), 39-48.

Kamiya, S., Yamakawa, K., Ogura, H., and Nakamura, S. (1989). Recovery of spores of Clostridium difficile altered by heat or alkali. J Med Microbiol 28(3), 217-221.

Kanamoto, T. et al., "Genetic Heterogeneities and Phenotypic Characteristics of Strains of the Genus Abiotrophia and Proposal of *Abiotrophia para-adiacens* sp. nov.," Journal of Clinical Microbiology, Feb. 2000, pp. 492-498, vol. 38, No. 2; Abiotropia para-adjacens gene for 16S rRNA, partial sequence, strain: Nucleotide: NCBI: GenBank: AB022027.1, last accessed Mar. 12, 2014, p. 8.

Kanehisa Laboratories. KEGG: Kyoto encyclopedia of genes and genomes. <http://www.genome.jp/kegg/> Accessed Mar. 27, 2014.

Karasawa, T. et al., "A Defined Growth Medium for Clostridium difficile," Microbiology, Feb. 1995, pp. 371-375, vol. 151, No. 2.

Kazamias, M. et al., "Enhanced Fermentation of Mannitol and Release of Cytotoxin by Clostridium difficile in Alkaline Culture Media," Applied and Environmental Microbiology, Jun. 1995, pp. 2425-2427, vol. 61, No. 6.

Kelly, D., Campbell, J.I., King, T.P., Grant, G., Jansson, E.A., Coutts, A.G.P., Pettersson, S., and Conway, S. (2003). Commensal anaerobic gut bacteria attenuate inflammation by regulating nuclear-cytoplasmic shuttling of PPAR-γ and RelA. Nature Immunology 5(1), 104-112.

Khoruts, A. (2013). How Does Fecal Microbiota Transplantation Treat Clostridium difficile Infection? <https://www.genome.gov/Multimedia/Slides/HumanMicrobiomeScience2013/39_Khoruts.pdf> Accessed Mar. 21, 2014.

Khoruts, A., and Sadowsky, M.J. (2011). Therapeutic transplantation of the distal gut microbiota. Mucosal Immunol 4(1), 4-7.

Khoruts, A., Dicksved, J., Jansson, J.K., and Sadowsky, M.J. (2010). Changes in the composition of the human fecal microbiome after bacteriotherapy for recurrent Clostridium difficile-associated diarrhea. J. Clin. Gastroenterol. 44(5), 354-360.

Kim, B., Kim, N.J., Kim, M., Kim, Y.S., Woo, J., and Ryu, J. (2003). Bacteraemia Due to Tribe Proteeae: A Review of 132 Cases During a Decade (1991-2000). Scandinavian Journal of Infectious Diseases 35(2), 98-103.

Klayraung, S., Viernstein, H., and Okonogi, S. (2009). Development of tablets containing probiotics: Effects of formulation and processing parameters on bacterial viability. International Journal of Pharmaceutics 370(1-2), 54-60.

Kong, Q., He, G.-Q., Jia, J.-L., Zhu, Q.-L., and Ruan, H. (2011). Oral Administration of Clostridium butyricum for Modulating Gastrointestinal Microflora in Mice. Curr Microbiol 62(2), 512-517.

Konstantinidis, K.T., Ramette, A., and Tiedje, J.M. (2006). The bacterial species definition in the genomic era. Philos Trans R Soc Lond B Biol Sci 361(1475), 1929-1940.

Koonin, E.V. (2002). Chapter 22 the clusters of orthologous groups (COGS) database: Phylogenetic classification of proteins from complete genomes. <http://www.ncbi.nlm.nih.gov/books/NBK21090/pdf/ch22.pdf> Accessed Mar. 27, 2014.

Koransky, J.R., Allen, S.D., and Dowell, V.R., Jr (1978). Use of ethanol for selective isolation of sporeforming microorganisms. Appl. Environ. Microbiol. 35(4), 762-765.

Kort, R., O'Brien, A.C., Stokkum, I.H.M. Van, Oomes, S.J.C.M., Crielaard, W., Hellingwerf, K.J., and Brul, S. (2005). Assessment of Heat Resistance of Bacterial Spores from Food Product Isolates by Fluorescence Monitoring of Dipicolinic Acid Release. Appl. Environ. Microbiol. 71(7), 3556-3564.

Kucerova, Z., Moura, H., Leitch, G.J., Sriram, R., Bern, C., Kawai, V., Vargas, D., Gilman, R.H., Ticona, E., and Vivar, A. (2004). Purification of Enterocytozoon bieneusi spores from stool specimens by gradient and cell sorting techniques. Journal of Clinical Microbiology 42(7), 3256-3261.

Kumar, M. et al., "Cholesterol-Lowering Probiotics as Potential Biotherapeutics for Metabolic Diseases," Experimental Diabetes Research, 2012, Article ID 902917, 14 pages, vol. 2012.

Kump, P.K., Grochenig, H.-P., Lackner, S., Trajanoski, S., Reicht, G., Hoffmann, K.M., Deutschmann, A., Wenzl, H.H., Petritsch, W., Krejs, G.J., et al. (2013). Alteration of intestinal dysbiosis by fecal microbiota transplantation does not induce remission in patients with chronic active ulcerative colitis. Inflamm. Bowel Dis. 19(10), 2155-2165.

Kunde, S., Pham, A., Bonczyk, S., Crumb, T., Duba, M., Conrad, H., Jr, Cloney, D., and Kugathasan, S. (2013). Safety, tolerability, and clinical response after fecal transplantation in children and young adults with ulcerative colitis. J. Pediatr. Gastroenterol. Nutr. 56(6), 597-601.

Landy, J., Al-Hassi, H.O., Mclaughlin, S.D., Walker, A.W., Ciclitira, P.J., Nicholls, R.J., Clark, S.K., and Hart, A.L. (2011). Review article: faecal transplantation therapy for gastrointestinal disease. Alimentary Pharmacology & Therapeutics 34(4), 409-415.

Lawley, T.D., Clare, S., Walker, A.W., Stares, M.D., Connor, T.R., Raisen, C., Goulding, D., Rad, R., Schreiber, F., Brandt, C., et al. (2012). Targeted Restoration of the Intestinal Microbiota with a

(56) References Cited

OTHER PUBLICATIONS

Simple, Defined Bacteriotherapy Resolves Relapsing Clostridium difficile Disease in Mice. PLoS Pathog 8(10), e1002995.

Lawson, P.A., Song, Y., Liu, C., Molitoris, D.R., Vaisanen, M.-L., Collins, M.D., and Finegold, S.M. (2004). *Anaerotruncus colihominis* gen. nov., sp. nov., from human faeces. Int J Syst Evol Microbiol 54(2), 413-417.

Lee, I.-K., and Liu, J.-W. (2006). Clinical characteristics and risk factors for mortality in Morganella morganii bacteremia. J Microbiol Immunol Infect 39(4), 328-334.

Lee, J.S., Cha, D.S., and Park, H.J. (2004). Survival of Freeze-Dried Lactobacillus bulgaricus KFRI 673 in Chitosan-Coated Calcium Alginate Microparticles. J. Agric. Food Chem. 52(24), 7300-7305.

Lee, M., Hesek, D., Shah, I.M., Oliver, A.G., Dworkin, J., and Mobashery, S. (2010). Synthetic peptidoglycan motifs for germination of bacterial spores. Chembiochem 11(18), 2525-2529.

Lehar, J. (2007). Chemical combination effects predict connectivity in biological systems, Molecular Systems Biology, pp. 1-14, vol. 3, Article No. 80.

Lemon, K.P., Armitage, G.C., Relman, D.A., and Fischbach, M.A. (2012). Microbiota-Targeted Therapies: An Ecological Perspective. Science Translational Medicine 4(137), 137rv5-137rv5.

Leslie, S.B., Israeli, E., Lighthart, B., Crowe, J.H., and Crowe, L.M. (1995). Trehalose and sucrose protect both membranes and proteins in intact bacteria during drying. Applied and Environmental Microbiology 61(10), 3592-3597.

Liggins, M., Ramirez, N., Magnuson, N., and Abel-Santos, E. (2011). Progesterone analogs influence germination of Clostridium sordellii and Clostridium difficile spores in vitro. J. Bacteriol. 193(11), 2776-2783.

Lindsay, J.A., Beaman, T.C., and Gerhardt, P. (1985). Protoplast water content of bacterial spores determined by buoyant density sedimentation. J. Bacteriol. 163(2), 735-737.

Liu, K., Linder, C.R., and Warnow, T. (2011). RAxML and FastTree: Comparing Two Methods for Large-Scale Maximum Likelihood Phylogeny Estimation. PLoS One 6(11), e27731.

Livingston, S.J., Kominos, S.D., and Yee, R.B. (1978). New medium for selection and presumptive identification of the Bacteroides fragilis group. J. Clin. Microbiol. 7(5), 448-453.

Lopetuso, L.R., Scaldaferri, F., Petito, V., and Gasbarrini, A. (2013). Commensal Clostridia: leading players in the maintenance of gut homeostasis. Gut Pathogens 5(1), 23.

Lodish, H. et al., "Viruses: Structure, Function, and Uses," Molecular Cell Biology, 4th Edition, 2000, pp. 1-12.

Lozupone, C., Faust, K., Raes, J., Faith, J.J., Frank, D.N., Zaneveld, J., Gordon, J.I., and Knight, R. (2012). Identifying genomic and metabolic features that can underlie early successional and opportunistic lifestyles of human gut symbionts. Genome Res 22(10), 1974-1984.

Malik, K.A. (1988). A new freeze-drying method for the preservation of nitrogen-fixing and other fragile bacteria. Journal of Microbiological Methods 8(5), 259-271.

Manichanh, C. (2006). Reduced diversity of faecal microbiota in Crohn's disease revealed by a metagenomic approach. Gut 55(2), 205-211.

Matsuda, K. et al., "Sensitive Quantitative Detection of Commensal Bacteria by rRNA-Targeted Reverse Transcription-PCR," Applied and Environmental Microbiology, Jan. 2007, pp. 32-39, vol. 73, No. 1.

Mbithi, J.N., Springthorpe, V.S., and Sattar, S.A. (1990). Chemical disinfection of hepatitis A virus on environmental surfaces. Applied and Environmental Microbiology 56(11), 3601-3604.

McGuire, G., Denham, M.C., and Balding, D.J. (2001). Models of Sequence Evolution for DNA Sequences Containing Gaps. Mol Biol Evol 18(4), 481-490.

McNulty, N.P., Yatsunenko, T., Hsiao, A., Faith, J.J., Muegge, B.D., Goodman, A.L., Henrissat, B., Oozeer, R., Cools-Portier, S., Gobert, G., et al. (2011). The impact of a consortium of fermented milk strains on the gut microbiome of gnotobiotic mice and monozygotic twins. Sci Transl Med 3(106), 106ra106.

Mevissen-Verhage, E.A., Marcelis, J.H., Vos, M.N. De, Amerongen, W.C.H., and Verhoef, J. (1987). Bifidobacterium, Bacteroides, and *Clostridium* spp. In fecal samples from breast-fed and bottle-fed infants with and without iron supplement. J. Clin. Microbiol. 25(2), 285-289.

Miller, R.S., and Hoskins, L.C. (1981). Mucin degradation in human colon ecosystems. Fecal population densities of mucin-degrading bacteria estimated by a "most probable number" method. Gastroenterology 81(4), 759-765.

Miyamoto-Shinohara, Y., Sukenobe, J., Imaizumi, T., Nakahara, T., and Others (2008). Survival of freeze-dried bacteria. The Journal of General and Applied Microbiology 54(1), 9.

Momose, Y. et al., "16S rRNA Gene Sequence-Based Analysis of Clostridia Related to Conversion of Germfree Mice to the Normal State," Journal of Applied Microbiology, 2009, pp. 2088-2097, vol. 107.

Morgan, C.A., Herman, N., White, P.A., and Vesey, G. (2006). Preservation of micro-organisms by drying; A review. Journal of Microbiological Methods 66(2), 183-193.

Murri, M., Leiva, I., Gomez-Zumaquero, J.M., Tinahones, F.J., Cardona, F., Soriguer, F., and Queipo-Ortuño, M.I. (2013). Gut microbiota in children with type 1 diabetes differs from that in healthy children: a case-control study. BMC Med 11(1), 1-12.

Myllyluoma, E. et al., "Effects of Multispecies Probiotic Combination on Helicobacter pylori Infection In Vitro," Clinical and Vaccine Immunology, Sep. 2008, pp. 1472-1482, vol. 15, No. 9.

New Zealand First Examination Report, New Zealand Application No. 709392, dated Oct. 5, 2015, 7 pages.

Nicholson, W.L., and Law, J.F. (1999). Method for purification of bacterial endospores from soils: UV resistance of natural Sonoran desert soil populations of *Bacillus* spp. with reference to< i> B. subtilis</i> strain 168. Journal of Microbiological Methods 35(1), 13-21.

NIH human microbiome project. <http://www.hmpdacc.org/> Accessed Mar. 27, 2014.

Nishio, J., Atarashi, K., Tanoue, T., Baba, M., Negishi, H., Yanai, H., Honda, K., Benoist, C., Mathis, D., and Taniguchi, T. (2013). Impact of TCR repetoire on intestinal homeostasis (Taos, NM).

Nitert, M.D., Barrett, H.L., Foxcroft, K., Tremellen, A., Wilkinson, S., Lingwood, B., Tobin, J.M., McSweeney, C., O'Rourke, P., McIntyre, H.D., et al. (2013). SPRING: an RCT study of probiotics in the prevention of gestational diabetes mellitus in overweight and obese women. BMC Pregnancy and Childbirth 13(1), 50.

Noack, J., Kleessen, B., Proll, J., Dongowski, G., and Blaut, M. (1998). Dietary guar gum and pectin stimulate intestinal microbial polyamine synthesis in rats. J. Nutr. 128(8), 1385-1391.

Nyangale, et al., "Gut Microbial Activity, Implications for Health and Disease: the Potential Role of Metabolite Analysis," J. Proteome Res., 2012, pp. 5573-5585. vol. 11, No. 12.

O'Hara, C.M., Brenner, F.W., and Miller, J.M. (2000). Classification, identification, and clinical significance of Proteus, Providencia, and Morganella. Clin. Microbiol. Rev. 13(4), 534-546.

Okada, Y., Setoyama, H., Matsumoto, S., Imaoka, A., Nanno, M., Kawaguchi, M., and Umesaki, Y. (1994). Effects of fecal microorganisms and their chloroform-resistant variants derived from mice, rats, and humans on immunological and physiological characteristics of the intestines of ex-germfree mice. Infect. Immun. 62(12), 5442-5446.

Olle, B. (2013). Medicines from microbiota. Nat. Biotechnol. 31(4), 309-315.

OpenBiome. Quality metrics. <http://static.squarespace.com/static/50e0c29ae4b0a05702af7e6a/t/52e19689e4b0b28f802c9b4e/1390517129976/OpenBiome%20Quality%20Metrics.pdf> Accessed Mar. 21, 2014.

Owens, C., Broussard, E., and Surawicz, C. (2013). Fecal microbiota transplantation and donor standardization. Trends in Microbiology 21(9), 443-445.

Paine, R.T. (1969). A note on trophic complexity and community stability. American Naturalist 103(929), 91-93.

Palmfeldt, J., and Hahn-Hägerdal, B. (2000). Influence of culture pH on survival of< i> Lactobacillus reuteri</i> subjected to freeze-drying. International Journal of Food Microbiology 55(1), 235-238.

(56) References Cited

OTHER PUBLICATIONS

Pamer, E.G. (2014). Fecal microbiota transplantation: effectiveness, complexities, and lingering concerns. Mucosal Immunology 7(2), 210-214.
Paredes-Sabja, D., Udompijitkul, P., and Sarker, M.R. (2009). Inorganic phosphate and sodium ions are cogerminants for spores of Clostridium perfringens type A food poisoning-related isolates. Appl. Environ. Microbiol. 75(19), 6299-6305.
Path Vaccine and Pharmaceutical Technologies Group. Summary of stability data for investigational formulations of vaccines. <http://www.path.org/publications/files/TS_vaccine_stability_table_invest.pdf> Accessed Mar. 21, 2014.
PCT International Search Report and Written Opinion, PCT Application No. PCT/US14/14744, dated May 21, 2014, 36 pages.
PCT International Search Report and Written Opinion, PCT Application No. PCT/US14/14747, dated Jun. 13, 2014, 27 pages.
PCT International Search Report and Written Opinion, PCT Application No. PCT/US14/14738, dated Jul. 30, 2014, 32 pages.
PCT International Search Report and Written Opinion, PCT Application No. PCT/US14/14745, dated Jul. 30, 2014, 31 pages.
PCT Invitation to Pay Additional Fees, PCT Application No. PCT/US14/14745, dated May 16, 2014, 2 pages.
PCT International Search Report and Written Opinion, PCT Application No. PCT/US13/71758, dated May 5, 2014, 45 pages.
PCT Invitation to Pay Additional Fees, PCT Application No. PCT/US14/70684, dated Mar. 24, 2015, 2 pages.
PCT International Search Report and Written Opinion, PCT Application No. PCT/US2014/067491, dated Apr. 2, 2015, 14 pages.
PCT International Search Report and Written Opinion, PCT Application No. PCT/US14/70684, dated Jun. 10, 2015, 24 pages.
PCT Invitation to Pay Additional Fees, PCT Application No. PCT/US13/71758, dated Feb. 25, 2014, 4 pages.
PCT Invitation to Pay Additional Fees, PCT Application No. PCT/US2014/014738, dated May 16, 2014, 2 pages.
PCT International Search Report and Written Opinion, PCT Application No. PCT/US2014/030817, dated Dec. 5, 2014, 16 pages.
PCT Invitation to Pay Additional Fees, PCT Application No. PCT/US2014/030817, dated Sep. 8, 2014, 5 pages.
PCT International Search Report and Written Opinion, PCT Application No. PCT/US2014/029539, dated Oct. 10, 2014, 17 pages.
PCT Invitation to Pay Additional Fees, PCT Application No. PCT/US14/29539, dated Jul. 31, 2014, 3 pages.
Peck, M.W. et al., "Development and Application of a New Method for Specific and Sensitive Enumeration of Spores of Nonproteolytic Clostridium Botulinum Types B, E and F in Foods and Food Materials," Applied and Environmental Microbiology, Oct. 2010, pp. 6607-6614, vol. 76, No. 19.
Pehkonen, K.S., Roos, Y.H., Miao, S., Ross, R.P., and Stanton, C. (2008). State transitions and physicochemical aspects of cryoprotection and stabilization in freeze-drying of Lactobacillus rhamnosus GG (LGG). Journal of Applied Microbiology 104(6), 1732-1743.
Peighambardoust, S.H., Golshan Tafti, A., and Hesari, J. (2011). Application of spray drying for preservation of lactic acid starter cultures: a review. Trends in Food Science & Technology 22(5), 215-224.
Pellegrino, P.M., Fell Jr., N.F., and Gillespie, J.B. (2002). Enhanced spore detection using dipicolinate extraction techniques. Analytica Chimica Acta 455(2), 167-177.
Perez, F., Pultz, M.J., Endimiani, A., Bonomo, R.A., and Donskey, C.J. (2011). Effect of antibiotic treatment on establishment and elimination of intestinal colonization by KPC-producing Klebsiella pneumoniae in mice. Antimicrob. Agents Chemother. 55(6), 2585-2589.
Perez, J., Springthorpe, V.S., and Sattar, S.A. (2011). Clospore: a liquid medium for producing high titers of semi-purified spores of Clostridium difficile. J AOAC Int 94(2), 618-626.
Peterson, D.A. et al., "Metagenomic Approaches for Defining the Pathogenesis of Inflammatory Bowel Diseases," Cell Host Microbe, Jun. 2008, pp. 417-427, vol. 3, No. 6.

Petrof, E.O., Claud, E.C., Gloor, G.B., and Allen-Vercoe, E. (2013a). Microbial ecosystems therapeutics: a new paradigm in medicine? Beneficial Microbes 4(1), 53-65.
Petrof, E.O., Gloor, G.B., Vanner, S.J., Weese, S.J., Carter, D., Daigneault, M.C., Brown, E.M., Schroeter, K., and Allen-Vercoe, E. (2013b). Stool substitute transplant therapy for the eradication of Clostridium difficile infection: "RePOOPulating" the gut, Microbiome, Jan. 9, 2013, p. 3, vol. 1, No. 1.
Picot, A., and Lacroix, C. (2004). Encapsulation of bifidobacteria in whey protein-based microcapsules and survival in simulated gastrointestinal conditions and in yoghurt. International Dairy Journal 14(6), 505-515.
Pinn, D. et al. (2013). Follow-up Study of Fecal Microbiota Transplantation (FMT) for the Treatment of Refractory Irritable Bowel Syndrome (IBS). Abstract ACG 2013.
Postgate, J.R., and Hunter, J.R. (1961). On the Survival of Frozen Bacteria. J Gen Microbiol 26(3), 367-378.
Prilassnig, M. et al., "Are Probiotics Detectable in Human Feces After Oral Uptake by Healthy Volunteers?" The Middle European Journal of Medicine, Aug. 2007, pp. 456-462, vol. 119, Nos. 15-16.
Pultz, N.J., Hoyen, C.K., and Donskey, C.J. (2004). Inhibition of methicillin-resistant Staphylococcus aureus by an in vitro continuous-flow culture containing human stool microflora. FEMS Microbiology Letters 241(2), 201-205.
Queenan, A.M., and Bush, K. (2007). Carbapenemases: the Versatile β-Lactamases. Clin. Microbiol. Rev. 20(3), 440-458.
Quigley, E.M.M. et al., "Small Intestinal Bacterial Overgrowth: Roles of Antibiotics, Prebiotics and Probiotics," Gastroenterology, Feb. 2006, pp. 78-90, vol. 130.
Raibaud, P., Ducluzeau, R., Dubos, F., Hudault, S., Bewa, H., and Muller, M.C. (1980). Implantation of bacteria from the digestive tract of man and various animals into gnotobiotic mice. Am J Clin Nutr 33(11), 2440-2447.
Ramirez, N., and Abel-Santos, E. (2010). Requirements for germination of Clostridium sordellii spores in vitro. J. Bacteriol. 192(2), 418-425.
Rao, A.V., Shiwnarain, N., and Maharaj, I. (1989). Survival of Microencapsulated Bifidobacterium pseudolongum in Simulated Gastric and Intestinal Juices. Canadian Institute of Food Science and Technology Journal 22(4), 345-349.
Reeves, A.E., Koenigsknecht, M.J., Bergin, I.L., and Young, V.B. (2012). Suppression of Clostridium difficile in the Gastrointestinal Tracts of Germfree Mice Inoculated with a Murine Isolate from the Family Lachnospiraceae. Infection and Immunity 80(11), 3786-3794.
Rexroad, J., Wiethoff, C.M., Jones, L.S., and Middaugh, C.R. (2002). Lyophilization and the thermostability of vaccines. Cell Preservation Technology 1(2), 91-104.
Ridaura, V.K., Faith, J.J., Rey, F.E., Cheng, J., Duncan, A.E., Kau, A.L., Griffin, N.W., Lombard, V., Henrissat, B., Bain, J.R., et al. (2013). Gut Microbiota from Twins Discordant for Obesity Modulate Metabolism in Mice. Science 341(6150), 1241214-1241214.
Rode, L.J., and Foster, J.W. (1961). Germination of bacterial spores with alkyl primary amines1. J Bacteriol 81(5), 768-779.
Roffe, C. (1996). Biotherapy for antibiotic-associated and other diarrhoeas. J. Infect. 32(1), 1-10.
Rohlke, F., Surawicz, C.M., and Stollman, N. (2010). Fecal flora reconstitution for recurrent Clostridium difficile infection: results and methodology. J. Clin. Gastroenterol. 44(8), 567-570.
Rosen, D.L., Sharpless, C., and McGown, L.B. (1997). Bacterial Spore Detection and Determination by Use of Terbium Dipicolinate Photoluminescence. Anal. Chem. 69(6), 1082-1085.
Sack, D.A., Shimko, J., Sack, R.B., Gomes, J.G., Macleod, K., O'Sullivan, D., and Spriggs, D. (1997). Comparison of alternative buffers for use with a new live oral cholera vaccine, Peru-15, in outpatient volunteers. Infect. Immun. 65(6), 2107-2111.
Sacks, L.E., and Alderton, G. (1961). Behavior of bacterial spores in aqueous polymer two-phase systems. J. Bacteriol. 82, 331-341.
Sahlström, L., Bagge, E., Emmoth, E., Holmqvist, A., Danielsson-Tham, M.-L., and Albihn, A. (2008). A laboratory study of survival of selected microorganisms after heat treatment of biowaste used in biogas plants. Bioresour. Technol. 99(16), 7859-7865.

(56) References Cited

OTHER PUBLICATIONS

Santivarangkna, C., Kulozik, U., and Foerst, P. (2007). Alternative Drying Processes for the Industrial Preservation of Lactic Acid Starter Cultures. Biotechnology Progress 23(2), 302-315.
Sattar, S.A., Jason, T., Bidawid, S., and Farber, J. (2000). Foodborne spread of hepatitis A: recent studies on virus survival, transfer and inactivation. The Canadian Journal of Infectious Diseases 11(3), 159.
Savaiano, D.A., Ritter, A.J., Klaenhammer, T., Walker, M.R., Carlson, H.L.F., and Ruckle, J. (2012). A Novel High Purity Short-Chain Galacto-Oligosaccharide (RP-G28) Improves Lactose Digestion and Symptoms of Lactose Intolerance. Gastroenterology 142(5), S-182.
Savaiano, D.A., Ritter, A.J., Klaenhammer, T.R., Walker, W.A., James, G.M., Longcore, A.T., Chandler, J.R., and Foyt, H.L. (2013). Improving lactose digestion and symptoms of lactose intolerance with a novel galacto-oligosaccharide (Rp-G28): a randomized, double-blind clinical trial. Nutrition Journal 12(1), 160.
Seale, R.B., Flint, S.H., McQuillan, A.J., and Bremer, P.J. (2008). Recovery of Spores from Thermophilic Dairy Bacilli and Effects of Their Surface Characteristics on Attachment to Different Surfaces. Appl Environ Microbiol 74(3), 731-737.
Seo, M., Inoue, I., Tanaka, M., Matsuda, N., Nakano, T., Awata, T., Katayama, S., Alpers, D.H., and Komoda, T. (2013). Clostridium butyricum Miyairi 588 improves high-fat diet-induced non-alcoholic fatty liver disease in rats. Dig. Dis. Sci. 58(12), 3534-3544.
Setlow, B., Cowan, A. E., and Setlow, P. (2003). Germination of spores of Bacillus subtilis with dodecylamine. Journal of Applied Microbiology 95(3), 637-648.
Setlow, B., Yu, J., Li, Y.-Q., and Setlow, P. (2013). Analysis of the germination kinetics of individual Bacillus subtilis spores treated with hydrogen peroxide or sodium hypochlorite. Letters in Applied Microbiology 57(4), 259-265.
Shafaat, H.S., and Ponce, A. (2006). Applications of a Rapid Endospore Viability Assay for Monitoring UV Inactivation and Characterizing Arctic Ice Cores. Appl Environ Microbiol 72(10), 6808-6814.
Shah, I.M., Laaberki, M.-H., Popham, D.L., and Dworkin, J. (2008). A eukaryotic-like Ser/Thr kinase signals bacteria to exit dormancy in response to peptidoglycan fragments. Cell 135(3), 486-496.
Shah, N.P., "Symposium: Probiotic Bacteria: Probiotic Bacteria: Selective Enumeration and Survival in Dairy Foods," Oct. 7, 1999, 14 pages.
Shah, N.P. et al., "Microencapsulation of Probiotic Bacteria and Their Survival in Frozen Fermented Dairy Desserts," The Australian Journal of Dairy Technology, Oct. 2000, pp. 139-144, vol. 55, No. 3.
Shah, S. (2012). Clostridium difficile in inflammatory Bowel Disease: a dangerous mix (Clostridium difficile Symposium, Miriam Hospital, Providence, RI).
Shahinas, D., Silverman, M., Sittler, T., Chiu, C., Kim, P., Allen-Vercoe, E., Weese, S., Wong, A., Low, D.E., and Pillai, D.R. (2012). Toward an Understanding of Changes in Diversity Associated with Fecal Microbiome Transplantation Based on 16S rRNA Gene Deep Sequencing. mBio 3(5), e00338-12-e00338-12.
Sharpe, E.S., Nickerson, K.W., Bulla Jr, L.A., and Aronson, J.N. (1975). Separation of spores and parasporal crystals of Bacillus thuringiensis in gradients of certain x-ray contrasting agents. Applied Microbiology 30(6), 1052.
Sheu, T.-Y., Marshall, R.T., and Heymann, H. (1993). Improving Survival of Culture Bacteria in Frozen Desserts by Microentrapment. Journal of Dairy Science 76(7), 1902-1907.
Siaterlis, A., Deepika, G., and Charalampopoulos, D. (2009). Effect of culture medium and cryoprotectants on the growth and survival of probiotic lactobacilli during freeze drying. Letters in Applied Microbiology 48(3), 295-301.
Sigma-Tau. VSL#3. <http://www.vsl3.com/> Accessed Mar. 21, 2014.
Skaar, E., "The Battle for Iron Between Bacterial Pathogens and Their Vertebrate Hosts," PLoS Pathog., Aug. 12, 2010, pp. 1-4, vol. 6, No. 8.
Snitkin, E.S., Zelazny, A.M., Thomas, P.J., Stock, F., Henderson, D.K., Palmore, T.N., and Segre, J.A. (2012). Tracking a Hospital Outbreak of Carbapenem-Resistant Klebsiella pneumoniae with Whole-Genome Sequencing. Sci Transl Med 4(148), 148ra116-148ra116.
Solanki, H.K., Pawar, D.D., Shah, D.A., Prajapati, V.D., Jani, G.K., Mulla, A.M., and Thakar, P.M. (2013). Development of Microencapsulation Delivery System for Long-Term Preservation of Probiotics as Biotherapeutics Agent. BioMed Research International 2013, 1-21.
SOP No. MB-28-00. <http://www.epa.gov/pesticides/methods/MB-28-00.pdf> Accessed Match 27, 2014.
Sorg, J.A., and Sonenshein, A.L. (2008). Bile Salts and Glycine as Cogerminants for Clostridium difficile Spores. J Bacteriol 190(7), 2505-2512.
Sow, H., Desbiens, M., Morales-Rayas, R., Ngazoa, S.E., and Jean, J. (2011). Heat Inactivation of Hepatitis A Virus and a Norovirus Surrogate in Soft-Shell Clams (Mya arenaria). Foodborne Pathogens and Disease 8(3), 387-393.
Stams, A.J.M., Van Dijk, J.B., Dijkema, C., and Plugge, C.M. (1993). Growth of Syntrophic Propionate-Oxidizing Bacteria with Fumarate in the Absence of Methanogenic Bacteria. Appl Environ Microbiol 59(4), 1114-1119.
Stevens, K.A., and Jaykus, L.-A. (2004). Bacterial Separation and Concentration from Complex Sample Matrices: A Review. Critical Reviews in Microbiology 30(1), 7-24.
Su, W.J., Waechter, M.J., Bourlioux, P., Dolegeal, M., Fourniat, J., and Mahuzier, G. (1987). Role of volatile fatty acids in colonization resistance to Clostridium difficile in gnotobiotic mice. Infect. Immun. 55(7), 1686-1691.
Talwalkar, A., and Kailasapathy, K. (2003). Effect of microencapsulation on oxygen toxicity in probiotic bacteria. Australian Journal of Dairy Technology 58(1), 36-39.
Tamir, H., and Gilvarg, C. (1966). Density Gradient Centrifugation for the Separation of Sporulating Forms of Bacteria. J. Biol. Chem. 241(5), 1085-1090.
Tanaka, M. et al., "Increased Fasting Plasma Ghrelin Levels in Patients with Bulimia Nervosa," European Journal of Endocrinology, Jun. 2002, pp. 1-3, vol. 146.
Taur, Y., and Pamer, E.G. (2014). Harnessing Microbiota to Kill a Pathogen: Fixing the microbiota to treat Clostridium difficile infections. Nature Medicine 20(3), 246-247.
Taur, Y., Xavier, J.B., Lipuma, L., Ubeda, C., Goldberg, J., Gobourne, A., Lee, Y.J., Dubin, K.A., Socci, N. D., Viale, A., et al. (2012). Intestinal Domination and the Risk of Bacteremia in Patients Undergoing Allogeneic Hematopoietic Stem Cell Transplantation. Clin Infect Dis 55(7), 905-914.
The Human Microbiome Project Consortium (2012). Structure, function and diversity of the healthy human microbiome. Nature 486(7402), 207-214.
Tisa, L.S., Koshikawa, T., and Gerhardt, P. (1982). Wet and dry bacterial spore densities determined by buoyant sedimentation. Applied and Environmental Microbiology 43(6), 1307-1310.
Tvede, M., and Rask-Madsen, J. (1989). Bacteriotherapy for chronic relapsing Clostridium difficile diarrhoea in six patients. Lancet 1(8648), 1156-1160.
Ubeda, C., Bucci, V., Caballero, S., Djukovic, A., Toussaint, N.C., Equinda, M., Lipuma, L., Ling, L., Gobourne, A., No, D., et al. (2013). Intestinal Microbiota Containing Barnesiella Species Cures Vancomycin-Resistant Enterococcus faecium Colonization. Infect. Immun. 81(3), 965-973.
Ubeda, C., Taur, Y., Jenq, R.R., Equinda, M.J., Son, T., Samstein, M., Viale, A., Socci, N.D., Van Den Brink, M.R.M., Kamboj, M., et al. (2010). Vancomycin-resistant Enterococcus domination of intestinal microbiota is enabled by antibiotic treatment in mice and precedes bloodstream invasion in humans. Journal of Clinical Investigation 120(12), 4332-4341.
United States Office Action, U.S. Appl. No. 14/313,828, dated Aug. 13, 2014, 5 pages.

(56) References Cited

OTHER PUBLICATIONS

United States Office Action, U.S. Appl. No. 14/313,828, dated Dec. 10, 2014, 7 pages.
United States Office Action, U.S. Appl. No. 14/313,828, dated May 15, 2015, 11 pages.
United States Office Action, U.S. Appl. No. 14/221,190, dated Jul. 22, 2014, 19 pages.
United States Office Action, U.S. Appl. No. 14/091,201, dated Mar. 25, 2014, 19 pages.
United States Office Action, U.S. Appl. No. 14/197,044, dated Aug. 13, 2014, 5 pages.
United States Office Action, U.S. Appl. No. 14/592,481, dated Dec. 22, 2015, 21 pages.
Van Der Woude, M.W., and Baumler, A.J. (2004). Phase and Antigenic Variation in Bacteria. Clin Microbiol Rev 17(3), 581-611.
Van Kregten, E., Westerdaal, N.A., and Willers, J.M. (1984). New, simple medium for selective recovery of Klebsiella pneumoniae and Klebsiella oxytoca from human feces. J Clin Microbiol 20(5), 936-941.
Van Nood, E., Vrieze, A., Nieuwdorp, M., Fuentes, S., Zoetendal, E.G., De Vos, W.M., Visser, C.E., Kuijper, E.J., Bartelsman, J.F.W. M., Tijssen, J.G.P., et al. (2013). Duodenal Infusion of Donor Feces for Recurrent Clostridium difficile. New England Journal of Medicine 368(5), 407-415.
Vandenplas, Y., Veereman, G., Van Der Werff Ten Bosch, J., Goossens, A., Pierard, D., Samsom, J.N., and Escher, J.C. (2014). Fecal Microbial Transplantation in a One-Year-Old Girl with Early Onset Colitis—Caution Advised: Journal of Pediatric Gastroenterology and Nutrition 1.
Vidal, M., Forestier, C., Charbonnel, N., Henard, S., Rabaud, C., and Lesens, O. (2010). Probiotics and Intestinal Colonization by Vancomycin-Resistant Enterococci in Mice and Humans. J Clin Microbiol 48(7), 2595-2598.
Villano, S.A., Seiberling, M., Tatarowicz, W., Monnot-Chase, E., and Gerding, D.N. (2012). Evaluation of an Oral Suspension of VP20621, Spores of Nontoxigenic Clostridium difficile Strain M3, in Healthy Subjects. Antimicrobial Agents and Chemotherapy 56(10), 5224-5229.
Wagman, J., and Weneck, E.J. (1963). Preservation of bacteria by circulating-gas freeze drying. Applied Microbiology 11(3), 244-248.
Waites, W.M., and Wyatt, L.R. (1971). Germination of spores of Clostridium bifermentans by certain amino acids, lactate and pyruvate in the presence of sodium or potassium ions. J. Gen. Microbiol. 67(2), 215-222.
Waites, W.M., and Wyatt, L.R. (1974). The effect of pH, germinants and temperature on the germination of spores of Clostridium bifermentans. J. Gen. Microbiol. 80(1), 253-258.
Walker, A.W., and Lawley, T.D. (2012). Therapeutic modulation of intestinal dysbiosis. Pharmacological Research 69(1), 75-86.
Wang, M. et al., "Comparison of Bacterial Diversity Along the Human Intestinal Tract by Direct Cloning and Sequencing of 16S rRNA Genes," FEMS Microbiology Ecology, 2005, pp. 219-231, vol. 54.
Wang, S., and Curtiss III, R. (2014). Development of *Streptococcus pneumoniae* Vaccines Using Live Vectors. Vaccines 2(1), 49-88.
Weingarden, A.R., Chen, C., Bobr, A., Yao, D., Lu, Y., Nelson, V.M., Sadowsky, M.J., and Khoruts, A. (2013). Microbiota transplantation restores normal fecal bile acid composition in recurrent Clostridium difficile infection. AJP: Gastrointestinal and Liver Physiology 306(4), G310-G319.
Wiencek, K.M. et al., "Hydrophobicity of Bacillus and Clostridium Spores," Applied and Environmental Microbiology, Sep. 1990, pp. 2600-2605, vol. 56, No. 9.
Wilson, K.H., and Sheagren, J.N. (1983). Antagonism of toxigenic Clostridium difficile by nontoxigenic C. difficile. Journal of Infectious Diseases 147(4), 733.
Wilson, K.H., Silva, J., and Fekety, F.R. (1981). Suppression of Clostridium difficile by Normal Hamster Cecal Flora and Prevention of Antibiotic-Associated Cecitis. Infect Immun 34(2), 626-628.
Wilson, K. et al., "Role of Competition for Nutrients in Suppression of Clostridium difficile by the Colonic Microflora," Infection and Immunity, Oct. 1988, pp. 2610-2614m vol. 56, No. 10.
Woo, T.D.H., Oka, K., Takahashi, M., Hojo, F., Osaki, T., Hanawa, T., Kurata, S., Yonezawa, H., and Kamiya, S. (2011). Inhibition of the cytotoxic effect of Clostridium difficile in vitro by Clostridium butyricum MIYAIRI 588 strain. J. Med. Microbiol. 60(Pt 11), 1617-1625.
Wróbel, B. (2008). Statistical measures of uncertainty for branches in phylogenetic trees inferred from molecular sequences by using model-based methods. J. Appl. Genet. 49(1), 49-67.
Wroblewski, D., Hannett, G.E., Bopp, D.J., Dumyati, G.K., Halse, T.A., Dumas, N. B., and Musser, K.A. (2009). Rapid Molecular Characterization of Clostridium difficile and Assessment of Populations of C. difficile in Stool Specimens. Journal of Clinical Microbiology 47(7), 2142-2148.
Yamakawa, K. et al., "Enhancement of Clostridium difficile Toxin Production in Biotin-Limited Conditions," J. Med. Microbiol., Feb. 1996, pp. 111-114, vol. 44, No. 2.
Yamamura, H., Hayakawa, M., and Iimura, Y. (2003). Application of sucrose-gradient centrifugation for selective isolation of *Nocardia* spp. from soil. Journal of Applied Microbiology 95(4), 677-685.
Yang, W.-W., and Ponce, A. (2009). Rapid endospore viability assay of Clostridium sporogenes spores. International Journal of Food Microbiology 133(3), 213-216.
Yang, W.-W., and Ponce, A. (2011). Validation of a Clostridium Endospore Viability Assay and Analysis of Greenland Ices and Atacama Desert Soils. Appl. Environ. Microbiol. 77(7), 2352-2358.
Yang, W.-W., Crow-Willard, E.N., and Ponce, A. (2009). Production and characterization of pure Clostridium spore suspensions. J. Appl. Microbiol. 106(1), 27-33.
Yang, W.W. (2010). Fast Viability Assessment of Clostridium Spores Survival in Extreme Environments. PhD thesis California Institute of Technology.
Yi, X., and Setlow, P. (2010). Studies of the Commitment Step in the Germination of Spores of *Bacillus* Species. J. Bacteriol. 192(13), 3424-3433.
Yung, P.T., and Ponce, A. (2008). Fast Sterility Assessment by Germinable-Endospore Biodosimetry. Appl. Environ. Microbiol. 74(24), 7669-7674.
Yunoki, M., Tsujikawa, M., Urayama, T., Sasaki, Y., Morita, M., Tanaka, H., Hattori, S., Takechi, K., and Ikuta, K. (2003). Heat sensitivity of human parvovirus B19. Vox Sanguinis 84(3), 164-169.
Zeng, Y., Fan, H., Chiueh, G., Pham, B., Martin, R., Lechuga-Ballesteros, D., Truong, V.L., Joshi, S.B., and Middaugh, C.R. (2009). Towards development of stable formulations of a live attenuated bacterial vaccine: a preformulation study facilitated by a biophysical approach. Hum Vaccin 5(5), 322-331.
Zhao, J., Krishna, V., Moudgil, B., and Koopman, B. (2008). Evaluation of endospore purification methods applied to Bacillus cereus. Separation and Purification Technology 61(3), 341-347.
Halmann, M. et al., "Stages in Germination of Spores of Bacillus Lichenformis," J. Bacteriol., 1962, pp. 1187-1193, vol. 84.
McFarland, L.V., "Use of Probiotics to Correct Dysbiosis of Normal Microbiota Following Disease or Disruptive Events: A Systematic Review," BMJ Open, 2014, pp. 1-18, vol. 4.
Mierau, I. et al., "Industrial-Scale Production and Purification of a Heterologous Protein in Lactococcus Lactis Using the Nisin-Controlled Gene Expression System Nice: The Case of Lysostaphin," Microbial Cell Factories, May 27, 2005, pp. 1-9, vol. 4, No. 15.
New Zealand First Examination Report, New Zealand Application No. 711771, dated Nov. 23, 2015, 6 pages.
New Zealand First Examination Report, New Zealand Application No. 711773, dated Nov. 24, 2015, 6 pages.
"Potentials of Probiotics in Pig Nutrition," AllAboutFeed News, Jan. 31, 2007, 6 pages.
Robinson, I.M. et al., "Emendation of Acetivibrio and Description of Acetivibrio ethanolgignens, a New Species from the Colons of Pigs with Dysentery," International Journal of Systematic Bacteriology, Jul. 1981, pp. 333-338, vol. 31, No. 3.
Russian Office Action, Russian Application No. 2015137399, dated Mar. 22, 2016, 8 pages.

(56) References Cited

OTHER PUBLICATIONS

United States Office Action, U.S. Appl. No. 15/068,438, dated Apr. 28, 2016, 9 pages.
United States Office Action, U.S. Appl. No. 14/884,655, dated May 5, 2016, 10 pages.
Van Immerseel, F. et al., "Butyric Acid-Producing Anaerobic Bacteria as a Novel Probiotic Treatment Approach for Inflammatory Bowel Disease," Journal of Medical Microbiology, JMM Editorial, 2010, pp. 141-143.
European Examination Report, European Application No. 14746341.8, dated Jun. 13, 2017, 11 pages.
New Zealand First Examination Report, New Zealand Application No. 713298, dated Feb. 28, 2017, 6 pages.
Australian First Examination Report, Australian Application No. 2013347805, dated Apr. 13, 2017, 3 pages.
Chiu, C-H. et al., "Rapid Identification of *Salmonella serovars* in Feces by Specific Detection of Virulence Genes, invA and spvC, by an Enrichment Broth Culture-Multiplex PCR Combination Assay," Journal of Clinical Microbiology, Oct. 1996, pp. 2619-2622, vol. 34, No. 10.
Coleman, W.H., "Mechanism of Killing Spores of Bacillus Cereus and Bacillus Megaterium by Wet Heat," The Society for Applied Microbiology, Letters in Applied Microbiology, 2010. pp. 507-514, vol. 50.
Dendukuri, N., "Probiotic Therapy for the Prevention and Treatment of Clostridium Difficile-Associated Diarrhea: A Systematic Review," Canadian Medical Association Journal, Jul. 19, 2005, pp. 167-170, vol. 173, No. 2.
European Extended Search Report, European Application No. 14745749.3, dated Jan. 23, 2017, 13 pages.
European Extended Search Report, European Application No. 13856249.1, dated Jan. 26, 2017, 19 pages.
Israel Office Action, Israel Application No. 238973, dated Apr. 20, 2017, 4 pages (with concise explanation of relevance).
Johnson, S. et al., "Is Primary Prevention of Clostridium Difficile Infection Possible with Specific Probiotics?" International Journal of Infectious Diseases, Nov. 2012, pp. e786-e792, vol. 16, No. 11.
McFarland, L.V. et al., "Pharmaceutical Probiotics for the Treatment of Anaerobic and Other Infections," Anaerobe, Jan. 1997, pp. 73-78, vol. 3, No. 2-3.
Russian Second Office Action, Russian Patent Application No. 2015137399, dated Mar. 14, 2017, 8 pages.
Setlow, B. et al., "Mechanisms of Killing Spores of Bacillus Subtilis by Acid, Alkali and Ethanol," Journal of Applied Microbiology, 2002, pp. 362-375, vol. 92.
United States Office Action, U.S. Appl. No. 14/765,810, dated Jan. 23, 2017, 19 pages.
United States Office Action, U.S. Appl. No. 14/776,676, dated Mar. 23, 2017, 9 pages.
United States Office Action, U.S. Appl. No. 14/777,252, dated May 11, 2017, 9 pages.
El-Houssieny, R. et al., "Recovery and Detection of Microbial Contaminants in Some Non-Sterile Pharmaceutical Products," Archives of Clinical Microbiology, 2013, pp. 1-14, vol. 4, No. 6: 1.
Japanese Office Action, Japanese Application No. 2015-556240, dated Jun. 5, 2018, 5 pages.
Manafi, M. Handbook of Culture Media for Food and Water Microbiology, 3$^{rd}$ Edition, Janet E.L. Corry et al., 2012, pp. 223-260.
Technical Data, HiMedia Laboratories Pvt. Ltd., M581BP, 2011, pp. 1-2.
United States Office Action, U.S. Appl. No. 15/359,439, dated Jun. 15, 2018, 14 pages.
United States Office Action, U.S. Appl. No. 14/776,676, dated Jun. 22, 2018, 16 pages.
United States Office Action, U.S. Appl. No. 15/039,007, dated Jun. 12, 2018, 9 pages.
Australian First Examination Report, Australian Application No. 2014232370, dated Oct. 19, 2017, 4 pages.
Australian First Examination Report, Australian Application No. 2014212004, dated Sep. 21, 2017, 6 pages.
Bergey's Manual of Determinative Bacteriology, Ninth Edition, John G. Holt et al., Williams & Wilkins, 1994, pp. 527, 531, 577, 579 (6 pages total).
Chinese First Office Action, Chinese Application No. 201480019395.8, dated Jul. 17, 2017, 29 pages.
Chinese Second Office Action, Chinese Application No. 201480019395.8, dated Apr. 4, 2018 (with concise explanation of relevance), 14 pages.
European Partial Supplementary Search Report, European Application No. 14870947.0, dated Jul. 11, 2017, 14 pages.
European Extended Search Report, European Application No. 14870947.0, dated Oct. 17, 2017, 11 pages.
European Examination Report, European Application No. 14745749.3, dated Oct. 31, 2017, 3 pages.
European Examination Report, European Application No. 14746455.6, dated Oct. 31, 2017, 6 pages.
European Examination Report, European Application No. 14763266.5, dated Nov. 13, 2017, 4 pages.
European Examination Report, European Application No. 14768281.9, dated Dec. 18, 2017, 4 pages.
European Examination Report, European Application No. 14745792.3, dated Dec. 21, 2017, 6 pages.
European Examination Report, European Application No. 14821918.1, dated Jan. 29, 2018, 4 pages.
European Examination Report, European Application No. 14746341.8, dated Apr. 18, 2018, 8 pages.
European Examination Report, European Application No. 13856249.1, dated May 23, 2018, 6 pages.
Hickson, M. et al., "Probiotics in the Prevention of Antibiotic-Associated Diarrhoea and Clostridium Difficile Infection," Therapeutic Advances in Gastroenterology, 2011, pp. 185-197, vol. 4, No. 3.
Japanese First Office Action, Japanese Application No. P2015-544179, dated Sep. 19, 2017, 8 pages.
Japanese Office Action, Japanese Application No. 2015-556241, dated Sep. 26, 2017, 12 pages.
Japanese Office Action, Japanese Application No. 2015-556240, dated Oct. 3, 2017, 8 pages.
Japanese Office Action, Japanese Application No. P2016-502561, dated Feb. 6, 2018, 10 pages.
Jordan, F. et al., "Network Ecology: Topological Constraints on Ecosystem Dynamics," Physics of Life Reviews, Dec. 2004, pp. 139-172, vol. 1, Issue 3 (Abstract Only).
Kim, J.Y. et al., "Effect of Oral Probiotics (Bifidobacterium lactis AD011 and Lactobacillus acidophilus AD031) Administration on Ovalbumin-Induced Food Allergy Mouse Model," J. Microbiol. Biotechnol., 2008, pp. 1393-1400, vol. 18, No. 8.
Li, A-D. et al., "Clinical Features and Bacterial Culture on Stools of Patients with Acute Diarrhea," Chinese Journal of Health Laboratory Technology, Mar. 10, 2012, pp. 559-561, vol. 2, No. 6.
New Zealand Examination Report, New Zealand Application No. 713298, dated Sep. 26, 2017, 5 pages.
New Zealand Third Examination Report, New Zealand Application No. 713298, dated Feb. 15, 2018, 6 pages.
New Zealand Fourth Examination Report, New Zealand Application No. 713298, dated Mar. 15, 2018, 2 pages.
Papadimitriou, K. et al., "Discovering Probiotic Microorganisms: In Vitro, In Vivo, Genetic and Omics Approaches," Frontiers in Microbiology, Feb. 17, 2015, pp. 1-28, vol. 6, Article 58.
Pharmacy, 2011, pp. 79-86, vol. 62, No. 3. [With English Main Sub-Points].
Pillai, A. et al., "Probiotics for Treatment of Clostridium Difficile-Associated Colitis in Adults (Review)," Cochrane Database of Systematic Reviews, The Cochrane Collaboration, John Wiley & Sons, Ltd., 2010, 18 pages.
Plassart, C. et al., "First Case of Intra-Abdominal Infection with Clostridium Disporicum," Anaerobe, 2013, pp. 77-78, vol. 19.
Prioult, G. et al., "Effect of Probiotic Bacteria on Induction and Maintenance of Oral Tolerance to β-Lactoglobulin in Gnotobiotic Mice," Clinical and Diagnostic Laboratory Immunology, Sep. 2003, pp. 787-792, vol. 10, No. 5.

(56) References Cited

OTHER PUBLICATIONS

Rehman, A. et al., "Effect of Probiotics and Antibiotics on the Intestinal Homeostasis in a Computer Controlled Model of the Large Intestine," BMC Microbiology, 2012, 10 pages, vol. 12, No. 47.
Russian Second Office Action, Russian Application No. 2015124366, dated Feb. 12, 2018, 10 pages.
Theriot, C.M. et al., "Antibiotic-Induced Shifts in the Mouse Gut Microbiome and Metabolome Increase Susceptibility to Clostridium difficile Infection," Nature Communications, Jan. 20, 2014, pp. 1-10, vol. 5.
United States Office Action, U.S. Appl. No. 14/777,252, dated Aug. 29, 2017, 16 pages.
United States Office Action, U.S. Appl. No. 15/104,873, dated Oct. 17, 2017, 7 pages.
United States Office Action, U.S. Appl. No. 15/039,007, dated Nov. 1, 2017, 13 pages.
United States Office Action, U.S. Appl. No. 14/765,810, dated Jan. 8, 2018, 8 pages.
United States Office Action, U.S. Appl. No. 14/765,810, dated Jan. 25, 2018, 11 pages.
United States Office Action, U.S. Appl. No. 14/765,814, dated Apr. 17, 2018, 15 pages.
Yuguchi Hiroya et al., "Hakkonyuu/nyuusankin inryou to chounaikinsou "Fermented Milk/Lactic Acid Bacteria Beverages and Intestinal Bacterial Flora,"" New Food Industry, UDA, Moritaka, New Food Industry K.K., 1987, pp. 71-88, vol. 29, No. 7. [With English Subtitle Translations].
Chinese First Office Action, Chinese Application No. 201380071190.X, dated Jul. 4, 2018, 11 pages (with concise explanation of relevance).
European Summons to Attend Oral Proceedings Pursuant to Rule 115(1) EPC, European Application No. 14768281.9, Jul. 11, 2018, 9 pages.
Mexican Office Action, Mexican Application No. MX/a/2015/006491, dated Jun. 25, 2018, 8 pages, (with concise explanation of relevance).
Mexican Office Action, Mexican Application No. MX/a/2015/009991, dated Jul. 16, 2018, (with concise explanation of relevance).
Sheptulin, A.A., "Refractory and Relapsing Forms of Clostridium difficile—Associated Colitis," www.gastro-j.ru, 2011, pp. 50-53 (with English abstract).
Hazenberg, M.P. et al., "Conversion of Germ-Free Mice to the Normal State by Clostridia," Zeitschrift fur Versuchstierkunde, 1976, pp. 185-190, vol. 18, No. 4.
Manichanh, C. et al., "Reshaping the Gut Microbiome with Bacterial Transplantation and Antibiotic Intake," Genome Research, 2010, pp. 1411-1419, vol. 20.
Thompson-Chagoyan, O.C. et al., "Aetiology of Inflammatory Bowel Disease (IBD): Role of Intestinal Microbiota and Gut-Associated Lymphoid Tissue Immune Response," Clinical Nutrition, Feb. 2005, pp. 339-352, vol. 24, No. 3.
Wilson, K.H. et al., "Interaction of Clostridium difficile and *Escherichia coli* with Microfloras in Continuous-Flow Cultures and Gnotobiotic Mice," Infection and Immunity, Nov. 1986, pp. 354-358, vol. 54, No. 2.
Holdeman, L.V. et al., "Human Fecal Flora: Variation in Bacterial Composition Within Individuals and a Possible Effect of Emotional Stress," Applied and Environmental Microbiology, Mar. 1976, pp. 359-375, vol. 31, No. 3.
Abt, M.C., et al., "Commensal Bacteria Calibrate the Activation Threshold of Innate Antiviral Immunity," Immunity, 37(1):158-170, Cell Press, United States, (Jul. 2012 ).
Barrasa, J.I., et al., "Bile Acids in the Colon, From Healthy to Cytotoxic Molecules.," Toxicology in Vitro : an International Journal Published in Association With Bibra, 27(2):964-977, Pergamon Press , England, (Mar. 2013).

Bartlett, J.G., et al., "Antibiotic-associated Pseudomembranous Colitis Due to Toxin-Producing Clostridia," The New England journal of medicine, 298(10):531-534, Massachusetts Medical Society, United States , (Mar. 1978).
Basler, M., et al., "Tit-for-tat: Type Vi Secretion System Counterattack During Bacterial Cell-cell Interactions," Cell, 152(4):884-894, Cell Press, United States, (Feb. 2013 ).
Basler, M., et al., "Type Vi Secretion Requires a Dynamic Contractile Phage Tail-like Structure," Nature, 483(7388):182-186, Nature Publishing Group, England, (Feb. 2012 ).
Bernstein, H., et al., "Bile Acids as Carcinogens in Human Gastrointestinal Cancers.," Mutation research, 589(1):47-65, Elsevier, Netherlands, (Jan. 2005).
Brandi et al., "Vancomycin-resistant enterococci exploit antibiotic-induced innate immune deficits,". Nature 455(7214):804-807 (2008).
Britton, R.A., et al., "Role of the Intestinal Microbiota in Resistance to Colonization by Clostridium Difficile," Gastroenterology 146(6):1547-1553, W.B. Saunders, United States (May 2014).
Buffie, C.G., et al., "Profound Alterations of Intestinal Microbiota Following a Single Dose of Clindamycin Results in Sustained Susceptibility to Clostridium Difficile-induced Colitis," Infection and Immunity, 80(1):62-73, American Society for Microbiology, United States, (Jan. 2012 ).
Caporaso, J.G., et al., "QIIME Allows Analysis of High-throughput Community Sequencing Data," Nature Methods, 7(5):335-336, Nature Publishing Group, United States, (May 2010 ).
Caporaso, J.G., et al., "Ultra-high-throughput Microbial Community Analysis on the Illumina Hiseq and Miseq Platforms," The Isme Journal, 6(8):1621-1624, Nature Publishing Group, England, (Aug. 2012).
Carlier, J.P., et al., "Proposal to Unify Clostridium Orbiscindens Winter et al. 1991 and Eubacterium Plautii (Séguin 1928) Hofstad and Aasjord 1982, With Description of *Flavonifractor plautii* Gen. Nov., Comb. Nov., and Reassignment of Bacteroides Capillosus to *Pseudoflavonifractor capillosus* Gen. Nov., Comb. Nov.," International Journal of Systematic and Evolutionary Microbiology 60(Pt 3):585-590, Microbiology Society, England (Mar. 2010).
Chen, X., et al., "Overview of Clostridium Difficile Infection: Implications for China," Gastroenterology Report, 1(3):153-158, Oxford University Press and Science Digestive, England, (Nov. 2013).
Chung, H., et al., "Gut Immune Maturation Depends on Colonization With a Host-specific Microbiota," Cell 149(7):1578-1593, Cell Press, United States (Jun. 2012).
Cohen, Statistical Power Analysis for the Behavioral Sciences, Second Edition (Routledge, Hillsdale, NJ, 1988).
De Aguiar Vallim, T.Q., et al., "Pleiotropic Roles of Bile Acids in Metabolism," Cell Metabolism, 17(5):657-669, Cell Press, United States, (May 2013).
Dethlefsen, L., et al., "Incomplete Recovery and Individualized Responses of the Human Distal Gut Microbiota to Repeated Antibiotic Perturbation," Proceedings of the National Academy of Sciences of the United States of America, 108 Suppl 1:4554-4561, National Academy of Sciences, United States, (Mar. 2011).
Diehl, G.E., et al., "Microbiota Restricts Trafficking of Bacteria to Mesenteric Lymph Nodes by Cx(3)cr1(Hi) Cells," Nature, 494(7435):116-120, Nature Publishing Group, England, (Feb. 2013).
Duan, J., et al., "Microbial Colonization Drives Expansion of Il-1 Receptor 1-expressing, Il-17-producing Gamma/delta T Cells," Cell host & microbe, 7(2):140-150, Cell Press, United States, (Feb. 2010).
Edgar, R.C., et al., "Uchime Improves Sensitivity and Speed of Chimera Detection," Bioinformatics, 27(16):2194-2200, Oxford University Press, England, (Aug. 2011).
Farache, J., et al., "Luminal Bacteria Recruit Cd103+ Dendritic Cells Into the Intestinal Epithelium to Sample Bacterial Antigens for Presentation," Immunity, 38(3):581-595, Cell Press, United States, (Mar. 2013).
Ferreira, B. R., et al., "The Intestinal Microbiota Plays a Role in *Salmonella*-induced Colitis Independent of Pathogen Colonization," Plos One, 6(5):e20338, Public Library of Science, United States, (May 2011).

(56) References Cited

OTHER PUBLICATIONS

Giel, J.L., et al., "Metabolism of Bile Salts in Mice Influences Spore Germination in Clostridium Difficile," Plos One, 5(1):e8740, Public Library of Science, United States, (Jan. 2010).

Hall, B.G., "Building Phylogenetic Trees From Molecular Data With Mega," Molecular biology and Evolution, 30(5):1229-1235, Oxford University Press, United States, (May 2013).

Hand, T.W., et al., "Acute Gastrointestinal Infection Induces Long-lived Microbiota-specific T Cell Responses," Science, 337(6101):1553-1556, American Association for the Advancement of Science, United States, (Sep. 2012).

Heeg, D., et al., "Spores of Clostridium difficile Clinical Isolates Display a Diverse Germination Response to Bile Salts," PLoS One 7(2):e32381 (2012).

Hill, D. A., et al., "Commensal bacteria-derived signals regulate basophil hematopoiesis and allergic inflammation," Nat Med., 18(4):538-546 (2012).

Huse, S.M., et al., "Exploring Microbial Diversity and Taxonomy Using SSU rRNA Hypervariable Tag Sequencing," PLoS Genetics 4(11):e1000255, Public Library of Science, United States (Nov. 2008).

International Search Report for International Application No. PCT/US2015/031627, ISA/US, Commissioner for Patents, Alexandria, Virginia, dated Sep. 8, 2015.

Ivanov, I. I., et al., "Induction of intestinal Th17 cells by segmented filamentous bacteria," Cell, 139(3):485-498 (2009).

Kang, D-J., et al., "Clostridium scindens baiCD and baiH genes encode stereo-specific 7alpha/7beta-hydroxy-3-oxo-delta4-cholenoic acid oxidoreductases," Biochim Biophys Acta 1781(1-2):16-25 (2008).

Kitahara, M., et al., "Assignment of *Eubacterium* sp. VPI 12708 and Related Strains with High Bile Acid 7alpha-dehydroxylating Activity to Clostridium Scindens and Proposal of *Clostridium hylemonae* sp. nov., Isolated from Human Faeces," International Journal of Systematic and Evolutionary Microbiology 50(3):971-978, Microbiology Society, England (May 2000).

Koeth, R.A., et al., "Intestinal Microbiota Metabolism of L-carnitine, a Nutrient in Red Meat, Promotes Atherosclerosis," Nature Medicine, 19(5):576-585, Nature Publishing Company, United States, (May 2013).

Krishna, S.G., et al., "Risk Factors, Preemptive Therapy, and Antiperistaltic Agents for Clostridium Difficile Infection in Cancer Patients," Transplant Infectious Disease, 15(5):493-501, Munksgaard, Denmark, (Oct. 2013 ).

Kyne, L., et al., "Health Care Costs and Mortality Associated With Nosocomial Diarrhea Due to Clostridium Difficile," Clinical Infectious Diseases, 34(3):346-353, Oxford University Press, United States, (Feb. 2002 ).

Langille, M.G., et al., "Predictive Functional Profiling of Microbial Communities Using 16s rRNA Marker Gene Sequences," Nature biotechnology, 31(9):814-821, Nature America Publishing, United States, (Sep. 2013).

Lathrop, S.K., et al., "Peripheral Education of the Immune System by Colonic Commensal Microbiota," Nature, 478(7368):250-252, Nature Publishing Group, England, (Sep. 2011).

Liu, C., et al., "Reclassification of Clostridium Coccoides, Ruminococcus Hansenii, Ruminococcus Hydrogenotrophicus, Ruminococcus Luti, Ruminococcus Productus and Ruminococcus Schinkii as *Blautia coccoides* Gen. Nov., Comb. Nov., Blautia Hansenii Comb. Nov., Blautia Comb. Nov., Blautia Schinkii Comb. Nov. and Description of *Blautia wexlerae* Sp. Nov., Isolated From Human Faeces," International Journal of Systematic and Evolutionary Microbiology 58(Pt 8):1896-1902, Microbiology Society, England (Aug. 2008).

Louie, T.J., et al., "Tolevamer, a Novel Nonantibiotic Polymer, Compared With Vancomycin in the Treatment of Mild to Moderately Severe Clostridium Difficile-associated Diarrhea," Clinical Infectious Diseases, 43(4):411-420, Oxford University Press, United States, (Aug. 2006).

Lozupone, C and Knight, R., "UniFrac: a New Phylogenetic Method for Comparing Microbial Communities," Applied and Environmental Microbiology 71(12):8228-8235, American Society for Microbiology, United States (Dec. 2005).

Macpherson, A.J and Uhr, T., "Induction of Protective Iga by Intestinal Dendritic Cells Carrying Commensal Bacteria," Science, 303(5664):1662-1665, American Association for the Advancement of Science, United States, (Mar. 2004).

Manges, A.R., et al., "Comparative Metagenomic Study of Alterations to the Intestinal Microbiota and Risk of Nosocomial Clostridium Difficile-associated Disease," The Journal of Infectious Diseases, 202(12):1877-1884, Oxford University Press, United States, (Dec. 2010).

Marsh, J.W., et al., "Association of Relapse of Clostridium Difficile Disease With Bi/nap1/027," Journal of Clinical Microbiology, 50(12):4078-4082, American Society for Microbiology, United States, (Dec. 2012).

Olszak, T., et al., "Microbial Exposure During Early Life Has Persistent Effects on Natural Killer T Cell Function," Science (New York, N.Y.), 336(6080):489-493, American Association for the Advancement of Science , United States, (Apr. 2012).

Ott, S.J., et al., "Quantification of Intestinal Bacterial Populations by Real-time PCR With a Universal Primer Set and Minor Groove Binder Probes: a Global Approach to the Enteric Flora," Journal of Clinical Microbiology, 42(6):2566-2572, American Society for Microbiology, United States, (Jun. 2004).

Out, C., et al., "Bile Acid Sequestrants: More Than Simple Resins," Current opinion in lipidology, 23(1):43-55, Lippincott Williams & Wilkins, England, (Feb. 2012).

Partial Supplementary European Search Report dated Jan. 4, 2018 in Application No. 15796000.6.

Rakoff-Nahoum, S., et al., "Recognition of Commensal Microflora by Toll-like Receptors is Required for Intestinal Homeostasis," Cell, 118(2):229-241, Cell Press, United States, (Jul. 2004).

Rea, M.C., et al., "Effect of Broad- and Narrow-spectrum Antimicrobials on Clostridium Difficile and Microbial Diversity in a Model of the Distal Colon," Proceedings of the National Academy of Sciences of the United States of America, 108 Suppl 1:4639-4644, National Academy of Sciences, United States, ( Mar. 2011 ).

Rea, M.C., et al., "Thuricin CD, a Posttranslationally Modified Bacteriocin With a Narrow Spectrum of Activity Against Clostridium Difficile," Proceedings of the National Academy of Sciences of the United States of America, 107(20):9352-9357, National Academy of Sciences, (May 2010).

Reeves, A.E., et al., "The Interplay Between Microbiome Dynamics and Pathogen Dynamics in a Murine Model of Clostridium Difficile Infection.," Gut Microbes, 2(3):145-158, Philadelphia, PA : Taylor & Francis, (May 2011).

Ridlon, J.M., "Enzymology and Molecular Biology of Bile Acid 7alpha- and 7beta- Dehydroxylation by the Intestinal Bacteria Clostridium Scindens and Clostridium Hylemonae," VCU Theses and Dissertations, Paper 736 (2008).

Ridlon, J.M and Hylemon, P.B., "Identification and Characterization of Two Bile Acid Coenzyme a Transferases From Clostridium Scindens, a Bile Acid 7α-dehydroxylating Intestinal Bacterium.," Journal of Lipid Research, 53(1):66-76, American Society for Biochemistry and Molecular Biology, United States, (Jan. 2012).

Ridlon, J.M., et al., "Clostridium Scindens: a Human Gut Microbe With a High Potential to Convert Glucocorticoids Into Androgens.," Journal of Lipid Research, 54(9):2437-2449, American Society for Biochemistry and Molecular Biology, United States, (Sep. 2013).

Ridlon,J.M,. et al, "Bile Salt Biotransformations by Human Intestinal Bacteria.," Journal of Lipid Research, 47(2):241-259, American Society for Biochemistry and Molecular Biology, (Feb. 2006).

Rupnik, M., et al., "Clostridium Difficile Infection: New Developments in Epidemiology and Pathogenesis.," Nature Reviews. Microbiology, 7(7):526-536, Nature Pub. Group, c2003-,England, (Jul. 2009).

Schloss, P.D., et al., "Introducing Mothur: Open-source, Platform-independent, Community-supported Software for Describing and Comparing Microbial Communities," Applied and Environmental Microbiology 75(23):7537- 7541, American Society for Microbiology, United States (Dec. 2009).

(56) References Cited

OTHER PUBLICATIONS

Sheneman, L., et al., "Clearcut: a Fast Implementation of Relaxed Neighbor Joining.," Bioinformatics (Oxford, England), 22(22):2823-2824, Oxford University Press, c1998,England, (Nov. 2006).
Sorg, J.A and Sonenshein, A.L., "Chenodeoxycholate is an Inhibitor of Clostridium Difficile Spore Germination.," Journal of Bacteriology, 191(3):1115-1117, American Society for Microbiology, United States, (Feb. 2009).
Stein, R.R., et al., "Ecological Modeling From Time-series Inference: Insight Into Dynamics and Stability of Intestinal Microbiota.," Plos Computational Biology, 9(12):e1003388, Public Library of Science, [2005], United States , (Sep. 2013).
Surawicz, C.M and Alexander, J., "Treatment of Refractory and Recurrent Clostridium Difficile Infection, " Nature Reviews Gastroenterology & Hepatology, 8(6):330-339, Nature Publishing Group, England (Jun. 2011).
Turnbaugh, P.J., et al., "A Core Gut Microbiome in Obese and Lean Twins.," Nature, 457(7228):480-484, Nature Publishing Group, England, (Jan. 2009).
Wells, J.E and Hylemon, P.B., "Identification and Characterization of a Bile Acid 7alpha-dehydroxylation Operon in *Clostridium* Sp. Strain TO-931, a Highly Active 7alpha-dehydroxylating Strain Isolated From Human Feces.," Applied and Environmental Microbiology, 66(3):1107-1113, American Society for Microbiology, United States, (Mar. 2000).
Wells, J.E., et al., "Development and Application of a Polymerase Chain Reaction Assay for the Detection and Enumeration of Bile Acid 7alpha-dehydroxylating Bacteria in Human Feces.," Clinica chimica acta; international journal of clinical chemistry, 331(1-2):127-134, Elsevier, Netherlands, (May 2003).
Wingender, G., et al., "Intestinal Microbes Affect Phenotypes and Functions of Invariant Natural Killer T Cells in Mice," Gastroenterology, 143(2):418-428, PA : W.B. Saunders, United States, (Aug. 2012).
Yutin, N. and Galperin, M.Y., "A Genomic Update on Clostridial Phylogeny: Gram-negative Spore-formers and Other Misplaced Clostridia," Environmental Microbiology 15(10):2631-2641, Blackwell Science, England (Oct. 2013).
Zar, F.A., et al., "A Comparison of Vancomycin and Metronidazole for the Treatment of Clostridium Difficile-associated Diarrhea, Stratified by Disease Severity.," Clinical Infectious Diseases : an Official Publication of the Infectious Diseases Society of America, 45(3):302-307, Oxford University Press, United States, (Aug. 2007).
Zhao, Y., et al., "RAPSearch2: a Fast and Memory-efficient Protein Similarity Search Tool for Next-generation Sequencing Data.," Bioinformatics (Oxford, England), 28(1):125-126, Oxford University Press, England, (Jan. 2012).
Anonymous, "Ecobiotic Drugs," Seres Therapeutics, Oct. 22, 2015, <http://web.archive.org/web/20151 022091731 /http://web.archive.org/web/20151ecobiotic-drugs, retrieved Mar. 7, 2017 (3 pages).
Anonymous, "Microbiome Therapeutics Platform," Seres Therapeutics, Retrieved on [Oct. 23, 2015], Retrieved from (http:/ /web.arch ive.org/web/20 151023063153/), Retrieved from (http://www.serestherapeutics.com/ourscience/ microbiome-therapeutics-platform), Retrieved on [Mar. 7, 2017], 3 pages.
Anonymous, "Product Pipeline," Seres Therapeutics, Oct. 22, 2015], Retrived from (< http: web.="" arch="" ive.org="" web="" 20="" 151="" 022091722="" http:="" http://www.serestherapeutics.com/pipeline/products) < /http: > , Retrieved on [Mar. 7, 2017], (3 pages).
Caballero, S. et al. "Distinct but Spatially Overlapping Intestinal Niches for Vancomycin-Resistant Enterococcus faecium and Carbapenem-Resistant Klebsiella pneumoniae" PLOS Pathogens 11(9):e1005132, Public Library of Science, United States (2015).
Cruz et al., "Immunosuppressive and Nonimmunosuppressive Cyclosporine Analogs Are Toxic to the Opportunistic Fungal Pathogen Cryptococcus neoformans via Cyclophilin-Dependent Inhibition of Calcineurin," Antimicrob. Agents Chemother. 44(1): 143-149, American Society for Microbiology (2000).
Fitzpatrick, L.R., "Probiotics for the treatment of Clostridium difficile associated disease", World Journal of Gastrointestinal Pathophysiology, 4(3): 47-52, Baishideng Publishing Group, United States (2013).
GenBank: NR_118589.1.
Gut definition. Merriam Webster Dictionary. https://www.merriam-webster.com/dictionary/gut, retrieved Mar. 9, 2020.
Wortman et al., "Design and evaluation of SER-262: A fermentation-derived microbiome therapeutic for the prevention of recurrence in patients with primary clostridium difficile infection," Seres Therapeutics, Cambridge, MA, Jun. 1, 2016, Retrieved from (http://serestherapeutics.com/sites/default/files/wortman_asm_poster_final_poster_ser_262.pdf), Retrieved on [Nov. 5, 2019], 1 page.
Marcus et al., "Deoxycholic acid and the pathogenesis of gall stones," Gut, 29, 522-533, BMJ Publishing Group, England (1988).
Office Action dated Feb. 26, 2019, in U.S. Appl. No. 15/312,610, Pamer, E. et al., filed Nov. 18, 2016, 22 pages.
Office Action dated Jul. 10, 2018, in U.S. Appl. No. 15/312,610, Pamer, E. et al., filed Nov. 18, 2016, 16 pages.
Office Action dated Sep. 20, 2019, in U.S. Appl. No. 15/986,369, Pamer, E. et al., filed May 22, 2018, 11 pages.
Office Action dated Dec. 21, 2018, in U.S. Appl. No. 15/986,369, Pamer, E. et al., filed May 22, 2018, 16 pages.
Rasti et al., "Inhibition of Clostridium scindens and Clostridium hiranonis growth by Bifidobacterium pseudocatenulatum G4 in simulated colonic pH ," Journal of Food Agriculture and Environment 11 (2): 127-131, WFL Publisher Ltd, Poland (2013).
Stackebrandt et al. "Taxonomic Note: A Place for DNA-DNA Reassociation and 16S rRNA Sequence Analysis in the Present Species Definition in Bacteriology," International Journal of Systematic Bacteriology 44(4): 846-849, International Union of Microbiological Societies (Oct. 1994).
Vogt et al. "Chemical communication in the gut: Effects of microbiota-generated metabolites on gastrointestinal bacterial pathogens," Anaerobe 34 106-115, Elsevier, Netherlands (2015).
Office Action dated Nov. 13, 2019, in U.S. Appl. No. 15/603,916, Van Den Brink; M. et al., filed May 24, 2017, 21 pages.
Office Action dated May 14, 2019, in U.S. Appl. No. 15/603,916, Van Den Brink; M. et al., filed May 24, 2017, 25 pages.
Office Action dated Mar. 28, 2019, in U.S. Appl. No. 15/603,916, Van Den Brink; M. et al., filed May 24, 2017, 24 pages.
Office Action dated Dec. 9, 2019, in U.S. Appl. No. 16/223,008, Matthew R. Henn et al., filed Dec. 17, 2018, 18 pages.
Office Action dated Nov. 1, 2019, in U.S. Appl. No. 16/054,864, Gregory McKenzie et al., filed Aug. 3, 2018, 11 pages.
Office Action dated Mar. 15, 2019, in U.S. Appl. No. 16/054,864, Gregory McKenzie et al., filed Aug. 3, 2018, 10 pages.
Office Action dated Jan. 18, 2019, in U.S. Appl. No. 14/765,814, David N. Cook et al., filed Aug. 4, 2015, 14 pages.
Office Action dated Nov. 14, 2019, in U.S. Appl. No. 14/765,814, David N. Cook et al., filed Aug. 4, 2015, 18 pages.
Office Action dated Dec. 31, 2019, in U.S. Appl. No. 16/051,747, Geoffrey von Maltzahn et al., filed Aug. 1, 2018, 47 pages.
Office Action dated Apr. 7, 2020, in U.S. Appl. No. 16/054,864, Gregory McKenzie et al., filed Aug. 3, 2018, 16 pages.
European Extended Search Report, European Application No. 14768281.9, dated Jul. 18, 2016, 10 pages.
European Extended Search Report, European Application No. 14763266.5, dated Aug. 16, 2016, 7 pages.
Joosten, H. et al., "Salmonelle Detection in Probiotic Products," International Journal of Food Microbiology, Jul. 2006, pp. 104-107, vol. 110, No. 1.
Kollmann, M. et al., Design Principles of a Bacterial Signalling Network, Nature, Nov. 24, 2005, pp. 504-507, vol. 438, No. 7067.
Logan, N.A., "Bacillus and Relatives in Foodborne Illness," Journal of Applied Microbiology, Mar. 20, 2012, pp. 417-429, vol. 112, No. 3.
Sleator, R.D. et al.,"Designer Probiotics: A Potential Therapeutic for Clostridium difficile?" Journal of Medical Microbiology, Jun. 2008, pp. 793-794, vol. 57, No. 6.
Stefka, A.T. et al., "Commensal Bacteria Protect Against Food Allergen Sensitization," PNAS, Sep. 9, 2014, pp. 13145-13150, vol. 111, No. 36.

(56) References Cited

OTHER PUBLICATIONS

Sensitization, PNAS, Sep. 9, 2014, pp. 13145-13150, vol. 111, No. 36.
United States Office Action, U.S. Appl. No. 14/884,655, dated Aug. 17, 2016, 9 pages.
European Extended Search Report, European Application No. 14746341.8, dated Sep. 28, 2016, 10 pages.
European Partial Supplementary Report, European Application No. 14745792.3, dated Sep. 20, 2016, 11 pages.
European Partial Supplementary Report, European Application No. 14745749.3, dated Oct. 14, 2016, 6 pages.
European Extended Search Report, European Application No. 14746455.6, dated Nov. 24, 2016, 10 pages.
European Extended Search Report, European Application No. 14745792.3, dated Dec. 23, 2016, 17 pages.
Janda, J.M. et al., "16S rRNA Gene Sequencing for Bacterial Identification in the Diagnostic Laboratory: Pluses, Perils and Pitfalls," Journal of Clinical Microbiology, Sep. 2007, pp. 2761-2764, vol. 45, No. 9.
New Zealand Third Examination Report, New Zealand Application No. 711771, dated Nov. 4, 2016, 4 pages.
Russian First Office Action, Russian Patent Application No. 2015124366, dated Dec. 13, 2016, 12 pages.
United States Office Action, U.S. Appl. No. 14/777,252, dated Nov. 3, 2016, 16 pages.
United States Office Action, U.S. Appl. No. 14/765,810, dated Jan. 23, 2017, 20 pages.

\* cited by examiner

```
   1  AAATTGAAGAGTTTGATCATGGCTCAGATTGAACGCTGGCGGCAGGCCTA
  51  ACACATGCAAGTCGAACGGTAACAGGAAGAAGCTTGCTCTTTGCTGACGA
 101  GTGGCGGACGGGTGAGTAATGTCTGGGAAACTGCCTGATGGAGGGGGATA
 151  ACTACTGGAAACGGTAGCTAATACCGCATAACGTCGCAAGACCAAAGAGG
 201  GGGACCTTCGGGCCTCTTGCCATCGGATGTGCCCAGATGGGATTAGCTAG
 251  TAGGTGGGGTAACGGCTCACCTAGGCGACGATCCCTAGCTGGTCTGAGAG
 301  GATGACCAGCCACACTGGAACTGAGACACGGTCCAGACTCCTACGGGAGG
 351  CAGCAGTGGGGAATATTGCACAATGGGCGCAAGCCTGATGCAGCCATGCC
 401  GCGTGTATGAAGAAGGCCTTCGGGTTGTAAAGTACTTTCAGCGGGGAGGA
 451  AGGGAGTAAAGTTAATACCTTTGCTCATTGACGTTACCCGCAGAAGAAGC
 501  ACCGGCTAACTCGTGCCCAGGCATGCGCAGGAATACGGAGGTGCAAGCGT
 551  TAATCGGAATTACTGGGCGTAAAGCGCACGCAGGCGGTTTGTTAAGTCAG
 601  ATGTGAAATCCCCGGGCTCAACCTGGGAACTGCATCTGATACTGGCAAGC
 651  TTGAGTCTCGTAGAGGGGGGTAGAATTCCAGGTGTAGCGGTGAAATGCGT
 701  AGAGATCTGGAGGAATACCGGTGGCGAAGGCGGCCCCCTGGACGAAGACT
 751  CACGCTCAGGTGCGAAAGCGTGGGGAGCAAACAGGATTAGATACCCTGGT
 801  AGTCCACGCCGTAAACGATGTCGACTTGGAGGTTGTGCCCTTGAGGCGTG
 851  GCTTCCGGAGCTAACGCGTTAAGTCGACCGCCTGGGGAGTACGGCCGCAA
 901  GGTTAAAACTCAAATGAATTGACGGGGGCCCGCACAAGCGGTGGAGCATG
 951  TGGTTTAATTCGATGCAACGCGAAGAACCTTACCTGGTCTTGACATCCAC
1001  GGAAGTTTTCAGAGATGAGAATGTGCCTTCGGGAACCGTGAGACAGGTGC
1051  TGCATGGCTGTCGTCAGCTCGTGTTGTGAAATGTTGGGTTAAGTCCCGCA
1101  ACGAGCGCAACCCTTATCCTTTGTTGCCAGCGGTCCGGCCGGGAACTCAA
1151  AGGAGACTGCCAGTGATAAACTGGAGGAAGGTGGGGATGACGTCAAGTCA
1201  TCATGGCCCTTACGACCAGGGCTACACACGTGCTACAATGGCGCATACAA
1251  AGAGAAGCGACCTCGCGAGAGCAAGCGGACCTCATAAAGTGCGTCGTAGT
1301  CCGGATTGGAGTCTGCAACTCGACTCCATGAAGTCGGAATCGCTAGTAAT
1351  CGTGGATCAGAATGCCACGGTGAATACGTTCCCGGGCCTTGTACACACCG
1401  CCCGMCACACCATGGGAGTGGGTTGCAAAAGAAGTAGGTAGCTTAACCTT
1451  CGGGAGGGCGCTTACCACTTTGTGATTCATGACTGGGGTGAAGTCGTAAC
1501  AAGGTAACCGTAGGGGAACCTGCGGTTGGATCACCTCCTTA
```

Figure 1B

COMPOSITIONS AND METHODS

RELATED APPLICATIONS

This application is the National Stage of International Application No. PCT/US14/14747, filed Feb. 4, 2014, which claims the benefit of U.S. Provisional Application No. 61/760,584, filed on Feb. 4, 2013, and to U.S. Provisional Application No. 61/760,585, filed on Feb. 4, 2013, and to U.S. Provisional Application No. 61/760,574, filed on Feb. 4, 2013, and to U.S. Provisional Application No. 61/760,606, filed on Feb. 4, 2013, and to U.S. Provisional Application No. 61/798,606, filed on Mar. 15, 2013, and to U.S. Provisional Application No. 61/926,928 61,926,918, filed on Jan. 13, 2014, each of which is incorporated herein by reference in its entirety for all purposes.

REFERENCE TO A SEQUENCE LISTING

This application includes a Sequence Listing submitted electronically as a text file named 25968US_CRF_sequencelisting.txt, created on Oct. 15, 2015, with a size of 4,165,632 bytes. The sequence listing is incorporated by reference.

BACKGROUND

Mammals are colonized by microbes in the gastrointestinal (GI) tract, on the skin, and in other epithelial and tissue niches such as the oral cavity, eye surface and vagina. The gastrointestinal tract harbors an abundant and diverse microbial community. It is a complex system, providing an environment or niche for a community of many different species or organisms, including diverse strains of bacteria. Hundreds of different species may form a commensal community in the GI tract in a healthy person, and this complement of organisms evolves from the time of birth to ultimately form a functionally mature microbial population by about 3 years of age. Interactions between microbial strains in these populations and between microbes and the host, e.g. the host immune system, shape the community structure, with availability of and competition for resources affecting the distribution of microbes. Such resources may be food, location and the availability of space to grow or a physical structure to which the microbe may attach. For example, host diet is involved in shaping the GI tract flora.

A healthy microbiota provides the host with multiple benefits, including colonization resistance to a broad spectrum of pathogens, essential nutrient biosynthesis and absorption, and immune stimulation that maintains a healthy gut epithelium and an appropriately controlled systemic immunity. In settings of 'dysbiosis' or disrupted symbiosis, microbiota functions can be lost or deranged, resulting in increased susceptibility to pathogens, altered metabolic profiles, or induction of proinflammatory signals that can result in local or systemic inflammation or autoimmunity. Thus, the intestinal microbiota plays a significant role in the pathogenesis of many diseases and disorders, including a variety of pathogenic infections of the gut. For instance, subjects become more susceptible to pathogenic infections when the normal intestinal microbiota has been disturbed due to use of broad-spectrum antibiotics. Many of these diseases and disorders are chronic conditions that significantly decrease a subject's quality of life and can be ultimately fatal.

Manufacturers of probiotics have asserted that their preparations of bacteria promote mammalian health by preserving the natural microflora in the GI tract and reinforcing the normal controls on aberrant immune responses. See, e.g., U.S. Pat. No. 8,034,601. Probiotics, however, have been limited to a very narrow group of genera and a correspondingly limited number of species; as such, they do not adequately replace the missing natural microflora of the GI tract in many situations.

Thus, there is a need for a method of populating a subject's gastrointestinal tract with a diverse and useful selection of microbiota in order to alter a dysbiosis. In response to the need for durable, efficient, and effective compositions and methods for treatment of GI diseases by way of restoring or enhancing microbiota functions, Applicants address these and other shortcomings of the art by providing compositions and methods for treating subjects.

SUMMARY OF THE INVENTION

Disclosed herein are therapeutic compositions comprising a bacterial population comprising at least three but fewer than nine bacterial strains selected from the group consisting of *Escherichia coli, Enterococcus faecalis, Clostridium innocuum, Clostridium ramosum, Clostridium bifermentans, Bacteroides ovatus, Bacteroides vulgatus, Bacteroides thetaiotaomicron*, and Blautia *producta*, wherein the composition is formulated for oral or gastric administration to a mammalian subject in an effective amount for prevention or treatment of a gastrointestinal disease, disorder or condition. In some embodiments, the bacterial strains are not a colonic bacterium and/or are not obtained from a fecal culture. In some embodiments, at least one *Bacteroides* species is detectably present in the mammalian subject prior to administration of the composition or, in other embodiments at least one *Bacteroides* species is not detectably present in the mammalian subject prior to administration of the composition, but is detectably present in the mammalian subject at least one hour after administration of the composition. In some embodiments, the mammalian subject has not received at least two doses of vancomycin, metronidazole and/or or similar antibiotic compound within one week prior to administration of the therapeutic composition. In some embodiments, a single administration is substantially effective to reduce *C. difficile* and/or *C. difficile* toxin content in a mammalian subject to whom the composition is administered. In some embodiments, one strain of *E. coli* is present in amounts at least 2, 5, 10, 50, 100 or more than 100 times greater than any other strain of *E. coli* present in the composition. In some embodiments, at least three bacterial strains are not present in the composition in equal ratios or are present in a ratio equivalent to the ratio of the bacterial strains in a reference mammalian subject. In some embodiments, at least one of the bacterial strains is provided in a concentration of greater than $1 \times 10^2$ viable bacteria per gram of composition or is provided in a concentration of less than $1 \times 10^8$ viable bacteria per gram of composition. In some embodiments, a plurality of the bacterial strains is provided in a concentration of less than $1 \times 10^8$ viable bacteria per gram of composition. In some embodiments, no more than nine different bacterial strains are used, wherein at least two strains are from the group selected from: *Escherichia coli, Enterococcus faecalis, Clostridium innocuum, Clostridium ramosum, Clostridium bifermentans, Bacteroided ovatus, Bacteroides vulgatus, Bacteroides thetaiotaomicron,* and *Blautia producta*. In some embodiments, the composition is formulated for oral administration as a solid, semi-solid, gel, or liquid form; in the form of a pill, tablet, capsule, or lozenge; the bacterial strains are substantially encapsulated in an enteric coating; and/or the bacterial strains are substantially inactive prior to localization in the gastrointestinal tract of a mammalian subject to whom the composition is administered. In some embodiments, no more than two of the bacterial strains are strains whose growth is substantially inhibited by an equivalent amount of *C. difficile* bacteria.

Also disclosed is a method of treating a mammalian subject suffering from or at risk of developing a gastrointestinal disease, disorder or condition, comprising the step of administering to the mammalian subject a therapeutic composition comprising a bacterial population as described herein, wherein the composition is formulated for oral or gastric administration. In some embodiments, the gastrointestinal disease, disorder or condition is selected from the group consisting of relapsing diarrhea caused by *C. difficile*, ulcerative colitis, colitis, Crohn's disease, and irritable bowel disease. In some embodiments, the mammalian subject is an agricultural mammal. In some embodiments, the bacterial population comprises at least six bacterial strains or comprises at least six but fewer than ten bacterial strains. In some embodiments, the therapeutic composition is administered only once prior to improvement of the disease, disorder or condition; wherein the therapeutic composition is administered at intervals greater than two days; the mammalian subject has not received at least two doses of vancomycin, metronidazole and/or or similar antibiotic compound within one week prior to administration of the therapeutic composition; the mammalian subject is not suffering from relapsing diarrhea caused by *C. difficile*; and/or the mammalian subject has not previously received an antibiotic compound in the one month prior to administration of the therapeutic composition.

Also disclosed is a method of treating a mammalian subject suffering from or at risk of developing a gastrointestinal disease, disorder or condition, comprising the step of administering to the mammalian subject any therapeutic composition disclosed herein.

Also disclosed is a method of treating a mammalian subject suffering from or at risk of developing a gastrointestinal disease, disorder or condition, or a metabolic disease, disorder or condition selected from the group consisting of diabetes and autism, comprising the step of administering to the mammalian subject a therapeutic composition comprising a bacterial population comprising at least three bacterial strains, wherein no greater than nine of the bacterial strains are members of a bacterial species selected from the group consisting of *Escherichia coli, Enterococcus faecalis, Clostridium innocuum, Clostridium ramosum, Clostridium bifermentans, Bacteroided ovatus, Bacteroides vulgatus, Bacteroides thetaiotaomicron*, and *Blautia producta*, wherein the composition is formulated for oral or gastric administration. In some embodiments, the method further comprises the step of detecting one or more of the administered bacterial strains in the mammalian subject subsequent to administration, for example, detecting a 16S nucleic acid sequence in at least one administered bacterial strain.

Also disclosed is a therapeutic composition comprising a bacterial population comprising at least three but fewer than nine bacterial strains, wherein the bacterial strains comprise 16S nucleic acid sequences at least 97% identical to reference 16S nucleic acid sequences in bacterial strains selected from the group consisting of *Escherichia coli, Enterococcus faecalis, Clostridium innocuum, Clostridium ramosum, Clostridium bifermentans, Bacteroides ovatus, Bacteroides vulgatus, Bacteroides thetaiotaomicron*, and *Blautia producta*, wherein the composition is formulated for oral or gastric administration to a mammalian subject in an effective amount for prevention or treatment of a gastrointestinal disease, disorder or condition.

Also disclosed is a therapeutic composition comprising a bacterial population comprising at least three but fewer than nine bacterial strains, wherein the bacterial strains comprise *Clostridium innocuum, Clostridium ramosum*, and *Clostridium bifermentans*, wherein the composition is formulated for oral or gastric administration to a mammalian subject in an effective amount for prevention or treatment of a gastrointestinal disease, disorder or condition.

Also disclosed is a therapeutic composition comprising a bacterial population comprising at least three but fewer than nine bacterial strains, wherein the bacterial strains do not comprise detectable amounts of *Bacteroides ovatus, Bacteroides vulgatus*, or *Bacteroides thetaiotaomicron*, wherein the composition is formulated for oral or gastric administration to a mammalian subject in an effective amount for prevention or treatment of a gastrointestinal disease, disorder or condition.

Also disclosed is a method of increasing diversity of a gastrointestinal microbiota in a mammalian subject in need thereof, comprising administering to the mammalian subject a therapeutic composition comprising a bacterial population comprising at least three but fewer than nine bacterial strains, wherein the bacterial strains comprise 16S nucleic acid sequences at least 97% identical to reference 16S nucleic acid sequences in bacterial strains selected from the group consisting of *Escherichia coli, Enterococcus faecalis, Clostridium innocuum, Clostridium ramosum, Clostridium bifermentans, Bacteroides ovatus, Bacteroides vulgatus, Bacteroides thetaiotaomicron*, and *Blautia producta*, wherein the composition is formulated for oral or gastric administration to a mammalian subject in an effective amount for increasing the diversity of the gastrointestinal microbiota of the mammalian subject subsequent to administration. In some embodiments, the diversity is increased for at least 1 day after administration or for at least 4 days after administration or for at least 7 days after administration or for at least 14 days after administration or for at least 21 days after administration. In some embodiments, wherein the mammalian subject is suffering from or at risk of developing a disease, disorder or condition other than a gastrointestinal disease, disorder or condition.

BRIEF DESCRIPTION OF THE DRAWINGS

FIG. 1B highlights in bold the nucleotide sequences for each hypervariable region in the exemplary reference *E. coli* 16S sequence (SEQ ID NO: 2043) described by Brosius et al.

Figure 1A:
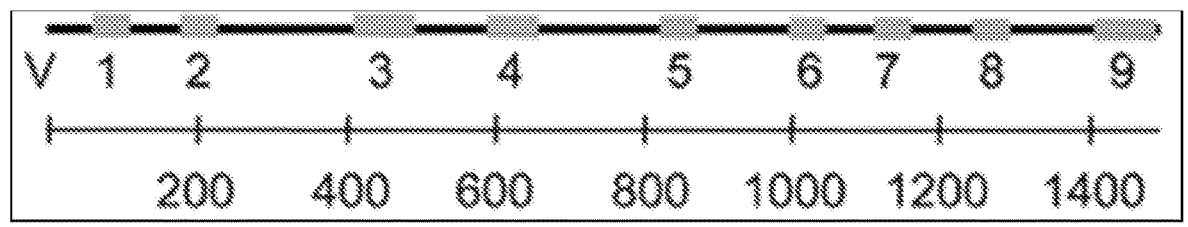
FIG. 1A provides a schematic of 16S rRNA gene and denotes the coordinates of hypervariable regions 1-9 (V1-V9). Coordinates of V1-V9 are 69-99, 137-242, 433-497, 576-682, 822-879, 986-1043, 1117-1173, 1243-1294, and 1435-1465 respectively, based on numbering using *E. coli* system of nomenclature defined by Brosius et al., Complete nucleotide sequence of a 16S ribosomal RNA gene (16S rRNA) from *Escherichia coli*, PNAS 75(10):4801-4805 (1978).

The figures depict various embodiments of the present invention for purposes of illustration only. One skilled in the art will readily recognize from the following discussion that alternative embodiments of the structures and methods illustrated herein may be employed without departing from the principles of the invention described herein.

DETAILED DESCRIPTION

Definitions

"Microbiota" refers to the community of microorganisms that occur (sustainably or transiently) in and on an animal subject, typically a mammal such as a human, including eukaryotes, archaea, bacteria, and viruses (including bacterial viruses i.e., phage).

"Microbiome" refers to the genetic content of the communities of microbes that live in and on the human body, both sustainably and transiently, including eukaryotes, archaea, bacteria, and viruses (including bacterial viruses (i.e., phage)), wherein "genetic content" includes genomic DNA, RNA such as ribosomal RNA, the epigenome, plasmids, and all other types of genetic information.

"Microbial Carriage" or simply "Carriage" refers to the population of microbes inhabiting a niche within or on humans. Carriage is often defined in terms of relative abundance. For example, OTU1 comprises 60% of the total microbial carriage, meaning that OTU1 has a relative abundance of 60% compared to the other OTUs in the sample from which the measurement was made. Carriage is most often based on genomic sequencing data where the relative abundance or carriage of a single OTU or group of OTUs is defined by the number of sequencing reads that are assigned to that OTU/s relative to the total number of sequencing reads for the sample.

"Microbial Augmentation" or simply "augmentation" refers to the establishment or significant increase of a population of microbes that are (i) absent or undetectable (as determined by the use of standard genomic and microbiological techniques) from the administered therapeutic microbial composition, (ii) absent, undetectable, or present at low frequencies in the host niche (as example: gastrointestinal tract, skin, anterior-nares, or vagina) before the delivery of the microbial composition, and (iii) are found after the administration of the microbial composition or significantly increase, for instance 2-fold, 5-fold, $1\times10^2$, $1\times10^3$, $1\times10^4$, $1\times10^5$, $1\times10^6$, $1\times10^7$, or greater than $1\times10^8$, in cases where they were present at low frequencies. The microbes that comprise an augmented ecology can be derived from exogenous sources such as food and the environment, or grow out from micro-niches within the host where they reside at low frequency.

The administration of the therapeutic microbial composition induces an environmental shift in the target niche that promotes favorable conditions for the growth of these commensal microbes. In the absence of treatment with a therapeutic microbial composition, the host can be constantly exposed to these microbes; however, sustained growth and the positive health effects associated with the stable population of increased levels of the microbes comprising the augmented ecology are not observed.

"Microbial Engraftment" or simply "engraftment" refers to the establishment of OTUs comprising a therapeutic microbial composition in a target niche that are absent in the treated host prior to treatment. The microbes that comprise the engrafted ecology are found in the therapeutic microbial composition and establish as constituents of the host microbial ecology upon treatment. Engrafted OTUs can establish for a transient period of time, or demonstrate long-term stability in the microbial ecology that populates the host post treatment with a therapeutic microbial composition. The engrafted ecology can induce an environmental shift in the target niche that promotes favorable conditions for the growth of commensal microbes capable of catalyzing a shift from a dysbiotic ecology to one representative of a health state.

"Ecological Niche" or simply "Niche" refers to the ecological space in which a an organism or group of organisms occupies. Niche describes how an organism or population or organisms responds to the distribution of resources, physical parameters (e.g., host tissue space) and competitors (e.g., by growing when resources are abundant, and when predators, parasites and pathogens are scarce) and how it in turn alters those same factors (e.g., limiting access to resources by other organisms, acting as a food source for predators and a consumer of prey).

"Dysbiosis" refers to a state of the microbiota of the gut or other body area in a subject, including mucosal or skin surfaces in which the normal diversity and/or function of the ecological network is disrupted. This unhealthy state can be due to a decrease in diversity, the overgrowth of one or more pathogens or pathobionts, symbiotic organisms able to cause disease only when certain genetic and/or environmental conditions are present in a subject, or the shift to an ecological microbial network that no longer provides an essential function to the host subject, and therefore no longer promotes health.

"Pathobionts" or "Opportunistic Pathogens" refers to symbiotic organisms able to cause disease only when certain genetic and/or environmental conditions are present in a subject.

"Phylogenetic tree" refers to a graphical representation of the evolutionary relationships of one genetic sequence to another that is generated using a defined set of phylogenetic reconstruction algorithms (e.g. parsimony, maximum likelihood, or Bayesian). Nodes in the tree represent distinct ancestral sequences and the confidence of any node is provided by a bootstrap or Bayesian posterior probability, which measures branch uncertainty.

"Operational taxonomic units," "OTU" (or plural, "OTUs") refer to a terminal leaf in a phylogenetic tree and is defined by a nucleic acid sequence, e.g., the entire genome, or a specific genetic sequence, and all sequences that share sequence identity to this nucleic acid sequence at the level of species. In some embodiments the specific genetic sequence may be the 16S sequence or a portion of the 16S sequence. In other embodiments, the entire genomes of two entities are sequenced and compared. In another embodiment, select regions such as multilocus sequence tags (MLST), specific genes, or sets of genes may be genetically compared. In 16S embodiments, OTUs that share ≥97% average nucleotide identity across the entire 16S or some variable region of the 16S are considered the same OTU (see e.g. Claesson M J, Wang Q, O'Sullivan O, Greene-Diniz R, Cole J R, Ross R P, and O'Toole P W. 2010. Comparison of two next-generation sequencing technologies for resolving highly complex microbiota composition using tandem variable 16S rRNA gene regions. *Nucleic Acids Res* 38: e200. Konstantinidis K T, Ramette A, and Tiedje J M. 2006. The bacterial species definition in the genomic era. *Philos Trans R Soc Lond B Biol Sci* 361: 1929-1940.). In embodiments involving the complete genome, MLSTs, specific genes, or sets of genes OTUs that share ≥95% average nucleotide identity are considered the same OTU (see e.g. Achtman M, and Wagner M. 2008. Microbial diversity and the genetic nature of microbial species. *Nat. Rev. Microbiol.* 6: 431-440. Konstantinidis K T, Ramette A, and Tiedje J M. 2006. The bacterial species definition in the genomic era. *Philos Trans R Soc Lond B Biol Sci* 361: 1929-1940.). OTUs are frequently defined by comparing sequences between organisms. Generally, sequences with less than 95% sequence identity are not considered to form part of the same OTU. OTUs may also be characterized by any combination of nucleotide markers or genes, in particular highly conserved genes (e.g., "housekeeping" genes), or a combination thereof. Such characterization employs, e.g., WGS data or a whole genome sequence.

Table 1 below shows a List of Operational Taxonomic Units (OTU) with taxonomic assignments made to Genus, Species, and Phylogenetic Clade. Clade membership of bacterial OTUs is based on 16S sequence data. Clades are defined based on the topology of a phylogenetic tree that is constructed from full-length 16S sequences using maximum likelihood methods familiar to individuals with ordinary skill in the art of phylogenetics. Clades are constructed to ensure that all OTUs in a given clade are: (i) within a specified number of bootstrap supported nodes from one another, and (ii) within 5% genetic similarity. OTUs that are within the same clade can be distinguished as genetically and phylogenetically distinct from OTUs in a different clade based on 16S-V4 sequence data, while OTUs falling within the same clade are closely related. OTUs falling within the same clade are evolutionarily closely related and may or may not be distinguishable from one another using 16S-V4 sequence data. Members of the same clade, due to their evolutionary relatedness, play similar functional roles in a microbial ecology such as that found in the human gut. Compositions substituting one species with another from the same clade are likely to have conserved ecological function and therefore are useful in the present invention. All OTUs are denoted as to their putative capacity to form spores and whether they are a Pathogen or Pathobiont (see Definitions for description of "Pathobiont"). NIAID Priority Pathogens are denoted as 'Category-A', 'Category-B', or 'Category-C', and Opportunistic Pathogens are denoted as 'OP'. OTUs that are not pathogenic or for which their ability to exist as a pathogen is unknown are denoted as 'N'. The 'SEQ ID Number' denotes the identifier of the OTU in the Sequence Listing File and 'Public DB Accession' denotes the identifier of the OTU in a public sequence repository.

"Residual habitat products" refers to material derived from the habitat for microbiota within or on a human or animal. For example, microbiota live in feces in the gastrointestinal tract, on the skin itself, in saliva, mucus of the respiratory tract, or secretions of the genitourinary tract (i.e., biological matter associated with the microbial community). Substantially free of residual habitat products means that the bacterial composition no longer contains the biological matter associated with the microbial environment on or in the human or animal subject and is 100% free, 99% free, 98% free, 97% free, 96% free, or 95% free of any contaminating biological matter associated with the microbial community. Residual habitat products can include abiotic materials (including undigested food) or it can include unwanted microorganisms. Substantially free of residual habitat products may also mean that the bacterial composition contains no detectable cells from a human or animal and that only microbial cells are detectable. In one embodiment, substantially free of residual habitat products may also mean that the bacterial composition contains no detectable viral (including bacterial viruses (i.e., phage)), fungal, mycoplasmal contaminants. In another embodiment, it means that fewer than $1\times10^{-2}\%$, $1\times10^{-3}\%$, $1\times10^{-4}\%$, $1\times10^{-5}\%$, $1\times10^{-6}\%$, $1\times10^{-7}\%$, $1\times10^{-8}$ of the viable cells in the bacterial composition are human or animal, as compared to microbial cells. There are multiple ways to accomplish this degree of purity, none of which are limiting. Thus, contamination may be reduced by isolating desired constituents through multiple steps of streaking to single colonies on solid media until replicate (such as, but not limited to, two) streaks from serial single colonies have shown only a single colony morphology. Alternatively, reduction of contamination can be accomplished by multiple rounds of serial dilutions to single desired cells (e.g., a dilution of $10^{-8}$ or $10^{-9}$), such as through multiple 10-fold serial dilutions. This can further be confirmed by showing that multiple isolated colonies have similar cell shapes and Gram staining behavior. Other methods for confirming adequate purity include genetic analysis (e.g. PCR, DNA sequencing), serology and antigen analysis, enzymatic and metabolic analysis, and methods using instrumentation such as flow cytometry with reagents that distinguish desired constituents from contaminants.

"Clade" refers to the OTUs or members of a phylogenetic tree that are downstream of a statistically valid node in a phylogenetic tree. The clade comprises a set of terminal leaves in the phylogenetic tree that is a distinct monophyletic evolutionary unit and that share some extent of sequence similarity.

16s Sequencing, 16s, 16s-rRNA, 16s-NGS: In microbiology, "16S sequencing" or "16S-rRNA" or "16S" refers to sequence derived by characterizing the nucleotides that comprise the 16S ribosomal RNA gene(s). The bacterial 16S rDNA is approximately 1500 nucleotides in length and is used in reconstructing the evolutionary relationships and sequence similarity of one bacterial isolate to another using phylogenetic approaches. 16S sequences are used for phylogenetic reconstruction as they are in general highly conserved, but contain specific hypervariable regions that harbor sufficient nucleotide diversity to differentiate genera and species of most bacteria.

The "V1-V9 regions" of the 16S rRNA refers to the first through ninth hypervariable regions of the 16S rRNA gene that are used for genetic typing of bacterial samples. These regions in bacteria are defined by nucleotides 69-99, 137-242, 433-497, 576-682, 822-879, 986-1043, 1117-1173, 1243-1294 and 1435-1465 respectively using numbering based on the *E. coli* system of nomenclature. Brosius et al., Complete nucleotide sequence of a 16S ribosomal RNA gene from *Escherichia coli*, PNAS 75(10):4801-4805 (1978). In some embodiments, at least one of the V1, V2, V3, V4, V5, V6, V7, V8, and V9 regions are used to characterize an OTU. In one embodiment, the V1, V2, and V3 regions are used to characterize an OTU. In another embodiment, the V3, V4, and V5 regions are used to characterize an OTU. In another embodiment, the V4 region is used to characterize an OTU. A person of ordinary skill in the art can identify the specific hypervariable regions of a candidate 16S rRNA by comparing the candidate sequence in question to a reference sequence and identifying the hypervariable regions based on similarity to the reference hypervariable regions, or alternatively, one can employ Whole Genome Shotgun (WGS) sequence characterization of microbes or a microbial community.

The term "subject" refers to any animal subject including humans, laboratory animals (e.g., primates, rats, mice), livestock (e.g., cows, sheep, goats, pigs, turkeys, and chickens), and household pets (e.g., dogs, cats, and rodents). The subject may be suffering from a dysbiosis, including, but not limited to, an infection due to a gastrointestinal pathogen or may be at risk of developing or transmitting to others an infection due to a gastrointestinal pathogen.

The term "phenotype" refers to a set of observable characteristics of an individual entity. As example an individual subject may have a phenotype of "health" or "disease". Phenotypes describe the state of an entity and all entities within a phenotype share the same set of characteristics that describe the phenotype. The phenotype of an individual results in part, or in whole, from the interaction of the entities genome and/or microbiome with the environment.

The term "Network Ecology" refers to a consortium of OTUs that co-occur in some number of subjects. As used herein, a "network" is defined mathematically by a graph delineating how specific nodes (i.e. OTUs) and edges (connections between specific OTUs) relate to one another to define the structural ecology of a consortium of OTUs. Any given Network Ecology will possess inherent phylogenetic diversity and functional properties. A Network Ecology can also be defined in terms of function where for example the nodes would be comprised of elements such as, but not limited to, enzymes, clusters of orthologous groups (COGS; www.ncbi.nlm.nih.gov/books/NBK21090/), or KEGG pathways (www.genome.jp/kegg/).

Network Class, Core Network, Core Network Ecology: The terms "Network Class", "Core Network" and "Core Network Ecology" refer to a group of network ecologies that in general are computationally determined to comprise ecologies with similar phylogenetic and/or functional characteristics. A Core Network therefore contains important biological features, defined either phylogenetically or functionally, of a group (i.e., a cluster) of related network ecologies. One representation of a Core Network Ecology is a designed consortium of microbes, typically non-pathogenic bacteria, that represents core features of a set of phylogenetically or functionally related network ecologies seen in many different subjects. In many occurrences, a Core Network, while designed as described herein, exists as a Network Ecology observed in one or more subjects. Core Network ecologies are useful for reversing or reducing a dysbiosis in subjects where the underlying, related Network Ecology has been disrupted.

The term "Keystone OTU" refers to one or more OTUs that are common to many network ecologies and are members of networks ecologies that occur in many subjects (i.e. are pervasive). Due to the ubiquitous nature of Keystone OTUs, they are central to the function of network ecologies in healthy subjects and are often missing or at reduced levels in subjects with disease. Keystone OTUs may exist in low, moderate, or high abundance in subjects.

The term "non-Keystone OTU" refers to an OTU that is observed in a Network Ecology and is not a keystone OTU.

The term "Phylogenetic Diversity" refers to the biodiversity present in a given Network Ecology or Core Network Ecology based on the OTUs that comprise the network. Phylogenetic diversity is a relative term, meaning that a Network Ecology or Core Network that is comparatively more phylogenetically diverse than another network contains a greater number of unique species, genera, and taxonomic families. Uniqueness of a species, genera, or taxonomic family is generally defined using a phylogenetic tree that represents the genetic diversity all species, genera, or taxonomic families relative to one another. In another embodiment phylogenetic diversity may be measured using the total branch length or average branch length of a phylogenetic tree.

"Spore" or "endospore" refers to an entity, particularly a bacterial entity, which is in a dormant, non-vegetative and non-reproductive stage. Spores are generally resistant to environmental stress such as radiation, desiccation, enzymatic treatment, temperature variation, nutrient deprivation, and chemical disinfectants.

A "spore population" refers to a plurality of spores present in a composition. Synonymous terms used herein include spore composition, spore preparation, ethanol treated spore fraction and spore ecology. A spore population may be purified from a fecal donation, e.g. via ethanol or heat treatment, or a density gradient separation or any combination of methods described herein to increase the purity, potency and/or concentration of spores in a sample. Alternatively, a spore population may be derived through culture methods starting from isolated spore former species or spore former OTUs or from a mixture of such species, either in vegetative or spore form.

In one embodiment, the spore preparation comprises spore forming species wherein residual non-spore forming species have been inactivated by chemical or physical treatments including ethanol, detergent, heat, sonication, and the like; or wherein the non-spore forming species have been removed from the spore preparation by various separations steps including density gradients, centrifugation, filtration and/or chromatography; or wherein inactivation and separation methods are combined to make the spore preparation. In yet another embodiment, the spore preparation comprises spore forming species that are enriched over viable non-spore formers or vegetative forms of spore formers. In this embodiment, spores are enriched by 2-fold, 5-fold, 10-fold, 50-fold, 100-fold, 1000-fold, 10,000-fold or greater than 10,000-fold ompared to all vegetative forms of bacteria. In yet another embodiment, the spores in the spore preparation undergo partial germination during processing and formulation such that the final composition comprises spores and vegetative bacteria derived from spore forming species.

A "germinant" is a material or composition or physical-chemical process capable of inducing vegetative growth of a bacterium that is in a dormant spore form, or group of bacteria in the spore form, either directly or indirectly in a host organism and/or in vitro.

A "sporulation induction agent" is a material or physical-chemical process that is capable of inducing sporulation in a bacterium, either directly or indirectly, in a host organism and/or in vitro.

To "increase production of bacterial spores" includes an activity or a sporulation induction agent. "Production" includes conversion of vegetative bacterial cells into spores and augmentation of the rate of such conversion, as well as decreasing the germination of bacteria in spore form, decreasing the rate of spore decay in vivo, or ex vivo, or to increasing the total output of spores (e.g. via an increase in volumetric output of fecal material).

The "colonization" of a host organism includes the non-transitory residence of a bacterium or other microscopic organism. As used herein, "reducing colonization" of a host subject's gastrointestinal tract (or any other microbiotal niche) by a pathogenic bacterium includes a reduction in the residence time of the pathogen in the gastrointestinal tract as well as a reduction in the number (or concentration) of the pathogen in the gastrointestinal tract or adhered to the luminal surface of the gastrointestinal tract. Measuring reductions of adherent pathogens may be demonstrated, e.g., by a biopsy sample, or reductions may be measured indirectly, e.g., by measuring the pathogenic burden in the stool of a mammalian host.

A "combination" of two or more bacteria includes the physical co-existence of the two bacteria, either in the same material or product or in physically connected products, as well as the temporal co-administration or co-localization of the two bacteria.

A "cytotoxic" activity or bacterium includes the ability to kill a bacterial cell, such as a pathogenic bacterial cell. A "cytostatic" activity or bacterium includes the ability to inhibit, partially or fully, growth, metabolism, and/or proliferation of a bacterial cell, such as a pathogenic bacterial cell.

To be free of "non-comestible products" means that a bacterial composition or other material provided herein does not have a substantial amount of a non-comestible product, e.g., a product or material that is inedible, harmful or otherwise undesired in a product suitable for administration, e.g., oral administration, to a human subject. Non-comestible products are often found in preparations of bacteria from the prior art.

As used herein the term "vitamin" is understood to include any of various fat-soluble or water-soluble organic substances (non-limiting examples include vitamin A, Vitamin B1 (thiamine), Vitamin B2 (riboflavin), Vitamin B3 (niacin or niacinamide), Vitamin B5 (pantothenic acid), Vitamin B6 (pyridoxine, pyridoxal, or pyridoxamine, or pyridoxine hydrochloride), Vitamin B7 (biotin), Vitamin B9 (folic acid), and Vitamin B12 (various cobalamins; commonly cyanocobalamin in vitamin supplements), vitamin C, vitamin D, vitamin E, vitamin K, K1 and K2 (i.e. MK-4, MK-7), folic acid and biotin) essential in minute amounts for normal growth and activity of the body and obtained naturally from plant and animal foods or synthetically made, pro-vitamins, derivatives, analogs.

As used herein, the term "minerals" is understood to include boron, calcium, chromium, copper, iodine, iron, magnesium, manganese, molybdenum, nickel, phosphorus, potassium, selenium, silicon, tin, vanadium, zinc, or combinations thereof.

As used herein, the term "antioxidant" is understood to include any one or more of various substances such as beta-carotene (a vitamin A precursor), vitamin C, vitamin E, and selenium) that inhibit oxidation or reactions promoted by Reactive Oxygen Species ("ROS") and other radical and non-radical species. Additionally, antioxidants are molecules capable of slowing or preventing the oxidation of other molecules. Non-limiting examples of antioxidants include astaxanthin, carotenoids, coenzyme Q10 ("CoQ10"), flavonoids, glutathione, Goji (wolfberry), hesperidin, lactowolfberry, lignan, lutein, lycopene, polyphenols, selenium, vitamin A, vitamin C, vitamin E, zeaxanthin, or combinations thereof.

Compositions of the Invention

Bacterial Compositions

We have identified combinations of commensal bacteria of the human gut microbiota with the capacity to meaningfully provide functions of a healthy microbiota when administered to mammalian hosts. Without being limited to a specific mechanism, it is thought that such compositions inhibit the growth of a pathogen such as *C. difficile, Salmonella* spp., enteropathogenic *E. coli*, and vancomycin-resistant *Enterococcus* spp. and other pathobionts, so that a healthy, diverse and protective microbiota can be maintained or, in the case of pathogenic bacterial infections such as recurrent *C. difficile* infection, repopulate the intestinal lumen to reestablish ecological control over potential pathogens. Furthermore, the bacterial compositions have the ability to shift the state of the gut microbiota toward a healthy state allowing for augmentation of the microbiota with commensal bacteria found in healthy microbiomes. The bacterial compositions may also engraft in the host themselves and remain present in the gut for 1 day, 1 week, 1 month, 1 year, or longer than 1 year.

Preferred bacterial species include *Escherichia coli, Streptococcus faecalis, Clostridium Innocuum, Clostridium ramosum, Clostridium bifermentans, Bacteroides ovatus, Bacteroides vulgatus, Bacteroides thetaiotaomicron*, and *Blautia producta*. As used herein, a "type" or more than one "types" of bacteria may be differentiated at the genus level, the species, level, the sub-species level, the strain level or by any other taxonomic method, as described herein and otherwise known in the art. Preferred bacterial species also include species that share 97% homology in the 16s rDNA region to the species of *Escherichia coli, Streptococcus faecalis, Clostridium Innocuum, Clostridium ramosum, Clostridium bifermentans, Bacteroides ovatus, Bacteroides vulgatus, Bacteroides thetaiotaomicron*, and *Blautia producta* as defined by the provided 16s sequences (See Table 1).

Bacterial compositions may consist essentially of no greater than a number of types of these preferred bacteria. For instance, a bacterial composition may comprise no more than 2, no more than 3, no more than 4, no more than 5, no more than 6, no more than 7, no more than 8, no more than 9, no more than 10, no more than 11, no more than 12, no more than 13, no more than 14, no more than 15, no more than 16, no more than 17, no more than 18, no more than 19, or no more than 20 types of bacteria, as defined by above species or operational taxonomic unit (OTU) encompassing such species.

Bacterial compositions may consist essentially of a range of numbers of species of these preferred bacteria, but the precise number of species in a given composition is not known. For instance, a bacterial composition may consist essentially of between 2 and 10, 3 and 10, 4 and 10, 5 and 10, 6 and 10, 7 and 10, 8 and 10, or 9 and 10; or 2 and 9, 3 and 9, 4 and 9, 5 and 9, 6 and 9, 7 and 8 or 8 and 9; or 2 and 8, 3 and 8, 4 and 8, 5 and 8, 6 and 8 or 7 and 8; or 2 and 7, 3 and 7, 4 and 7, 5 and 7, or 6 and 7; or 2 and 6, 3 and 6, 4 and 6 or 5 and 6; or 2 and 5, 3 and 5 or 4 and 5; or 2 and 4 or 3 and 4; or 2 and 3, as defined by above species or operational taxonomic unit (OTU) encompassing such species.

Bacterial compositions containing a plurality of species may be provided such that the relative concentration of a given species in the composition to any other species in the composition is known or unknown. Such relative concentrations of any two species, or OTUs, may be expressed as a ratio, where the ratio of a first species or OTU to a second species or OTU is 1:1 or any ratio other than 1:1, such as 1:2, 1:3, 1:4, 1:5, 1:6, 1:7, 1:8, 1:9, 1:10, 1:15, 1:20, 1:25; 1:50; 1:75, 1:100, 1:200, 1:500; 1:1000, 1:10,000, 1:100,000 or greater than 1:100,000. The ratio of bacterial strains present in a bacterial composition may be determined by the ratio of the bacterial strains in a reference mammalian subject, e.g., a healthy human not suffering from or at known risk of developing a dysbiosis.

Bacterial compositions comprising a plurality of species may be provided such that the concentration of a given strain, or the aggregate of all strains, is between $1\times10^4$ and $1\times10^{15}$ viable bacteria per gram of composition or per administered dose. For example the concentration of a given strain, or the aggregate of all strains, is e.g., $1\times10^4$, $1\times10^5$, $1\times10^6$, $1\times10^7$, $1\times10^8$, $1\times10^9$, $1\times10^{10}$, $1\times10^{11}$, $1\times10^{12}$, $1\times10^{13}$, $1\times10^{14}$, $1\times10^{15}$, or greater than $1\times10^{15}$ viable bacteria per gram of composition or per administered dose. Alternatively, the concentration of a given strain, or the aggregate of all strains, is below a given concentration e.g., below $1\times10^4$, $1\times10^5$, $1\times10^6$, $1\times10^7$, $1\times10^8$, $1\times10^9$, $1\times10^{10}$, $1\times10^{11}$, $1\times10^{12}$, $1\times10^{13}$, $1\times10^{14}$, $1\times10^{15}$, or below $1\times10^{15}$ viable bacteria per gram of composition or per administered dose.

In certain embodiments, the bacterial compositions comprise a plurality of strains of the same species of bacteria. In certain embodiments, the strain of bacteria is present in amounts at least 2, 5, 10, 50, 100 or more than 100 times greater than any other strain of that species present in the composition. For example, provided are compositions containing one strain of *E. coli*, where this strain is present in amounts at least 2, 5, 10, 50, 100 or more than 100 times greater than any other strain of *E. coli* present in the composition.

Because pathogenic bacteria such as *C. difficile* bacteria may inhibit growth of the bacterial strains present in the composition, it is generally beneficial such that no more than two of the bacterial strains in the bacterial composition are strains whose growth is substantially inhibited, e.g., in vitro, by an equivalent amount of *C. difficile* bacteria.

In one embodiment, the bacterial composition comprises at least one and preferably more than one of the following species or a species that is 97% identical based on the 16s rDNA: *Barnesiella intestinihominis*; *Lactobacillus reuteri*; a species characterized as one of *Enterococcus hirae*, *Enterococus faecium*, or *Enterococcus durans*; a species characterized as one of *Anaerostipes caccae* or *Clostridium indolis*; a species characterized as one of *Staphylococcus warneri* or *Staphylococcus pasteuri*; and *Adlercreutzia equolifaciens*. In an alternative embodiment, at least one of the preceding species is not substantially present in the bacterial composition.

In one embodiment, the bacterial composition comprises at least one and preferably more than one of the following species or a species that is 97% identical based on the 16s rDNA: *Clostridium absonum*, *Clostridium argentinense*, *Clostridium baratii*, *Clostridium bifermentans*, *Clostridium botulinum*, *Clostridium butyricum*, *Clostridium cadaveris*, *Clostridium camis*, *Clostridium celaturn*, *Clostridium chauvoei*, *Clostridium clostridioforme*, *Clostridium cochlearium*, *Clostridium difficile*, *Clostridium fallax*, *Clostridium felsineum*, *Clostridium ghonii*, *Clostridium glycolicum*, *Clostridium haemolyticum*, *Clostridium hastiforme*, *Clostridium histolyticum*, *Clostridium indolis*, *Clostridium innocuum*, *Clostridium irregulare*, *Clostridium limosum*, *Clostridium malenominaturn*, *Clostridium novyi*, *Clostridium oroticum*, *Clostridium paraputrificum*, *Clostridium perfringens*, *Clostridium piliforme*, *Clostridium putrefaciens*, *Clostridium putrificum*, *Clostridium ramosum*, *Clostridium sardiniense*, *Clostridium sartagoforme*, *Clostridium scindens*, *Clostridium septicum*, *Clostridium sordeffii*, *Clostridium sphenoides*, *Clostridium spiroforme*, *Clostridium sporogenes*, *Clostridium subterminale*, *Clostridium symbiosum*, *Clostridium tedium*, *Clostridium tetani*, *Clostridium welchii*, and *Clostridium villosum*. In an alternative embodiment, at least one of the preceding species is not substantially present in the bacterial composition.

In one embodiment, the bacterial composition comprises at least one and preferably more than one of the following species or a species that is 97% identical based on the 16s rDNA: *Clostridium innocuum*, *Clostridum bifermentans*, *Clostridium butyricum*, *Bacteroides fragilis*, *Bacteroides thetaiotaomicron*, *Bacteroides uniformis*, three strains of *Escherichia coli*, and *Lactobacillus* sp. In an alternative embodiment, at least one of the preceding species is not substantially present in the bacterial composition.

In one embodiment, the bacterial composition comprises at least one and preferably more than one of the following species or a species that is 97% identical based on the 16s rDNA: *Clostridium bifermentans*, *Clostridium innocuum*, *Clostridium butyricum*, three strains of *Escherichia coli*, three strains of *Bacteroides*, and *Blautia producta*. In an alternative embodiment, at least one of the preceding species is not substantially present in the bacterial composition.

In one embodiment, the bacterial composition comprises at least one and preferably more than one of the following species or a species that is 97% identical based on the 16s rDNA: *Bacteroides* sp., *Escherichia coli*, and non pathogenic *Clostridia*, including *Clostridium innocuum*, *Clostridium bifermentans* and *Clostridium ramosum*. In an alternative embodiment, at least one of the preceding species is not substantially present in the bacterial composition.

In one embodiment, the bacterial composition comprises at least one and preferably more than one of the following species or a species that is 97% identical based on the 16s rDNA: *Bacteroides* species, *Escherichia coli* and non-pathogenic *Clostridia*, such as *Clostridium butyricum*, *Clostridium bifermentans* and *Clostridium innocuum*. In an alternative embodiment, at least one of the preceding species is not substantially present in the bacterial composition.

In one embodiment, the bacterial composition comprises at least one and preferably more than one of the following species or a species that is 97% identical based on the 16s rDNA: *Bacteroides caccae*, *Bacteroides capillosus*, *Bacteroides coagulans*, *Bacteroides distasonis*, *Bacteroides eggerthii*, *Bacteroides forsythus*, *Bacteroides fragilis*, *Bacteroides fragilis-ryhm*, *Bacteroides gracilis*, *Bacteroides levii*, *Bacteroides macacae*, *Bacteroides merdae*, *Bacteroides ovatus*, *Bacteroides pneumosintes*, *Bacteroides putredinis*, *Bacteroides pyogenes*, *Bacteroides splanchnicus*, *Bacteroides stercoris*, *Bacteroides tectum*, *Bacteroides thetaiotaomicron*, *Bacteroides uniformis*, *Bacteroides ureolyticus*, and *Bacteroides vulgatus*. In an alternative embodiment, at least one of the preceding species is not substantially present in the bacterial composition.

In one embodiment, the bacterial composition comprises at least one and preferably more than one of the following species or a species that is 97% identical based on the 16s rDNA: *Bacteroides*, *Eubacteria*, *Fusobacteria*, *Propionibacteria*, *Lactobacilli*, anaerobic cocci, *Ruminococcus*, *Escherichia coli*, *Gemmiger*, *Desulfomonas*, and *Peptostreptococcus*. In an alternative embodiment, at least one of the preceding species is not substantially present in the bacterial composition.

In one embodiment, the bacterial composition comprises at least one and preferably more than one of the following species or a species that is 97% identical based on the 16s rDNA: *Bacteroides fragilis* ss. *Vulgatus, Eubacterium aerofaciens, Bacteroides fragilis* ss. *Thetaiotaomicron, Blautia producta* (previously known as *Peptostreptococcus productus* II), *Bacteroides fragilis* ss. *Distasonis, Fusobacterium prausnitzii, Coprococcus eutactus, Eubacterium aerofaciens* III, *Blautia producta* (previously known as *Peptostreptococcus productus* I), *Ruminococcus bronii, Bifidobacterium adolescentis, Gemmiger formicilis, Bifidobacterium longum, Eubacterium siraeum, Ruminococcus torques, Eubacterium rectale* III-H, *Eubacterium rectale* IV, *Eubacterium eligens, Bacteroides eggerthii, Clostridium leptum, Bacteroides fragilis* ss. A, *Eubacterium biforme, Bifidobacterium infantis, Eubacterium rectale* III-F, *Coprococcus comes, Bacteroides capillosus, Ruminococcus albus, Eubacterium formicigenerans, Eubacterium haffii, Eubacterium ventriosum I, Fusobacterium russii, Ruminococcus obeum, Eubacterium rectale* II, *Clostridium ramosum* I, *Lactobacillus leichmanii, Ruminococcus cailidus, Butyrivibrio crossotus, Acidaminococcus fermentans, Eubacterium ventriosum, Bacteroides fragilis* ss. *fragilis, Bacteroides* AR, *Coprococcus catus, Eubacterium hadrum, Eubacterium cylindroides, Eubacterium ruminantium, Eubacterium* CH-1, *Staphylococcus epidermidis, Peptostreptococcus* BL, *Eubacterium limosum, Bacteroides praeacutus, Bacteroides* L, *Fusobacterium mortiferum* I, *Fusobacterium naviforme, Clostridium innocuum, Clostridium ramosum, Propionibacterium acnes, Ruminococcus flavefaciens, Ruminococcus* AT, *Peptococcus* AU-1, *Eubacterium* AG, -AK, -AL, -AL-1, -AN; *Bacteroides fragilis* ss. *ovatus*, -ss. d, -ss. f, *Bacteroides* L-1, L-5; *Fusobacterium nucleatum, Fusobacterium mortiferum, Escherichia coli, Streptococcus morbiliorum, Peptococcus magnus, Peptococcus* G, AU-2; *Streptococcus intermedius, Ruminococcus lactaris, Ruminococcus* CO *Gemmiger* X, *Coprococcus* BH, -CC; *Eubacterium tenue, Eubacterium ramulus, Eubacterium* AE, -AG-H, -AG-M, -AJ, -BN-1; *Bacteroides clostridiiformis* ss. *clostridliformis, Bacteroides coagulans, Bacteroides orails, Bacteroides ruminicola* ss. *brevis*, -ss. *ruminicola, Bacteroides splanchnicus, Desuifomonas pigra, Bacteroides* L-4, -N-i; *Fusobacterium* H, *Lactobacillus* G, and *Succinivibrio* A. In an alternative embodiment, at least one of the preceding species is not substantially present in the bacterial composition.

Bacterial Compositions Described by Operational Taxonomic Unit (OTUs)

Bacterial compositions may be prepared comprising at least two types of isolated bacteria, chosen from the species in Table 1.

A bacterial composition may be prepared comprising at least two types of isolated bacteria, wherein a first type is a first OTU comprising a species of *E. coli, S. faecalis, Cl. Innocuum, Cl. ramosum, Cl. bifermentans, Bact. ovatus, Bact. vulgatus, Bact. thetaiotaomicron*, or *Blautia producta* and the type is a second OTU is characterized by, i.e., at least 95%, 96%, 97%, 98%, 99% or including 100% sequence identity to, the first OTU. In some embodiments, two types of bacteria are provided in a composition, and the first bacteria and the second bacteria are not the same OTU.

OTUs can be defined either by full 16S sequencing of the rRNA gene (Table 1), by sequencing of a specific hypervariable region of this gene (i.e. V1, V2, V3, V4, V5, V6, V7, V8, or V9), or by sequencing of any combination of hypervariable regions from this gene (e.g. V1-3 or V3-5). The bacterial 16S rDNA is approximately 1500 nucleotides in length and is used in reconstructing the evolutionary relationships and sequence similarity of one bacterial isolate to another using phylogenetic approaches. 16S sequences are used for phylogenetic reconstruction as they are in general highly conserved, but contain specific hypervariable regions that harbor sufficient nucleotide diversity to differentiate genera and species of most microbes.

Using well known techniques, in order to determine the full 16S sequence or the sequence of any hypervariable region of the 16S sequence, genomic DNA is extracted from a bacterial sample, the 16S rDNA (full region or specific hypervariable regions) amplified using polymerase chain reaction (PCR), the PCR products cleaned, and nucleotide sequences delineated to determine the genetic composition of 16S gene or subdomain of the gene. If full 16S sequencing is performed, the sequencing method used may be, but is not limited to, Sanger sequencing. If one or more hypervariable regions are used, such as the V4 region, the sequencing can be, but is not limited to being, performed using the Sanger method or using a next-generation sequencing method, such as an Illumina (sequencing by synthesis) method using barcoded primers allowing for multiplex reactions.

OTUs can be defined by a combination of nucleotide markers or genes, in particular highly conserved genes (e.g., "house-keeping" genes), or a combination thereof, full-genome sequence, or partial genome sequence generated using amplified genetic products, or whole genome sequence (WGS). Using well defined methods DNA extracted from a bacterial sample will have specific genomic regions amplified using PCR and sequenced to determine the nucleotide sequence of the amplified products. In the whole genome shotgun (WGS) method, extracted DNA will be directly sequenced without amplification. Sequence data can be generated using any sequencing technology including, but not limited to Sanger, Illumina, 454 Life Sciences, Ion Torrent, ABI, Pacific Biosciences, and/or Oxford Nanopore.

In one embodiment, the OTUs can be characterized by one or more of the variable regions of the 16S sequence (V1-V9). These regions in bacteria are defined by nucleotides 69-99, 137-242, 433-497, 576-682, 822-879, 986-1043, 1117-1173, 1243-1294 and 1435-1465 respectively using numbering based on the *E. coli* system of nomenclature. (See, e.g., Brosius et al., Complete nucleotide sequence of a 16S ribosomal RNA gene from *Escherichia coli*, PNAS 75(10):4801-4805 (1978)). In some embodiments, at least one of the V1, V2, V3, V4, V5, V6, V7, V8, and V9 regions are used to characterize an OTU. In one embodiment, the V1, V2, and V3 regions are used to characterize an OTU. In another embodiment, the V3, V4, and V5 regions are used to characterize an OTU. In another embodiment, the V4 region is used to characterize an OTU.

Inhibition of Bacterial Pathogens

In some embodiments, the bacterial composition provides a protective or therapeutic effect against infection by one or more GI pathogens of interest. A list of exemplary bacterial pathogens and pathobionts is provided in Table 1.

In some embodiments, the pathogenic bacterium is selected from the group consisting of *Yersinia, Vibrio, Treponema, Streptococcus, Staphylococcus, Shigella, Salmonella, Rickettsia, Orientia, Pseudomonas, Neisseria, Mycoplasma, Mycobacterium, Listeria, Leptospira, Legionella, Klebsiella, Helicobacter, Haemophilus, Francisella, Escherichia, Ehrlichia, Enterococcus, Coxiella, Corynebacterium, Clostridium, Chlamydia, Chlamydophila, Campylobacter, Burkholderia, Brucella, Borrelia, Bordetella, Bifidobacterium, Bacillus*, multi-drug resistant bacteria, extended spectrum beta-lactam resistant Enterococci (ESBL), Carbapenem-resistant Enterobacteriaceae (CRE), and vancomycin-resistant Enterococci (VRE).

In some embodiments, these pathogens include, but are not limited to, *Aeromonas hydrophila*, *Campylobacter fetus*, *Plesiomonas shigelloides*, *Bacillus cereus*, *Campylobacter jejuni*, *Clostridium botulinum*, *Clostridium difficile*, *Clostridium perfringens*, enteroaggregative *Escherichia coli*, enterohemorrhagic *Escherichia coli*, enteroinvasive *Escherichia coli*, enterotoxigenic *Escherichia coli* (such as, but not limited to, LT and/or ST), *Escherichia coli* 0157:H7, *Helicobacter pylori*, *Klebsiellia pneumonia*, *Lysteria monocytogenes*, *Plesiomonas shigelloides*, *Salmonella* spp., *Salmonella typhi*, *Salmonella paratyphi*, *Shigella* spp., *Staphylococcus* spp., *Staphylococcus aureus*, vancomycin-resistant enterococcus spp., *Vibrio* spp., *Vibrio cholerae*, *Vibrio parahaemolyticus*, *Vibrio vulnificus*, and *Yersinia enterocolitica*.

In one embodiment, the pathogen of interest is at least one pathogen chosen from *Clostridium difficile*, *Salmonella* spp., pathogenic *Escherichia coli*, vancomycin-resistant *Enterococcus* spp., and extended spectrum beta-lactam resistant Enterococci (ESBL).

Generation and Formulation of Bacterial Compositions

The bacterial compositions are generally formulated for oral or gastric administration, typically to a mammalian subject. Preferably, such formulations contain or are coated by an enteric coating to protect the bacteria through the stomach and small intestine. In particular embodiments, the composition is formulated for oral administration as a solid, semi-solid, powder, gel, or liquid form, such as in the form of a pill, tablet, capsule, or lozenge.

The bacterial strains may, individually or together, be substantially inactive prior to localization in the gastrointestinal tract of the mammalian subject to whom the composition is administered. The bacterial strains may be lyophilized or otherwise acted upon to increase long-term storage viability.

Preferential species include *E. coli*, *S. faecalis*, *Cl. Innocuum*, *Cl. ramosum*, *Cl. bifermentans*, *Bact. ovatus*, *Bact. vulgatus*, *Bact. thetaiotaomicron*, and *Blautia producta*, or species 97% identical to the 16s rDNA sequences of these species and are generally provided in bacterial compositions containing at least three strains. In certain embodiments, at least one of the bacterial strains is not a colonic bacterium. In another embodiment, at least one of the bacterial strains is not obtained from a fecal culture, e.g., the bacterial strain is obtained from culturing a non-fecal biological material from a subject, from an environmental source, or from repeatedly streaking and purifying strains from any source. Alternatively, at least one bacterial strain is genetically engineered. In another embodiment, at least one species is present in the composition in spore form. In an alternative embodiment, all of the species are present as vegetative forms, substantially free of spores.

The bacterial compositions may be formulated to be effective in a given mammalian subject in a single administration or over multiple administrations. For example, a single administration is substantially effective to reduce *C. difficile* and/or *C. difficile* toxin content in a mammalian subject to whom the composition is administered. Alternatively, a single administration is substantially effective to reduce vancomycin resistant Enterococci, carbapenem resistant bacteria, or another pathobiont in a mammalian subject to whom the composition is administered (See Table 1). Substantially effective means that *C. difficile* and/or *C. difficile* toxin and/or pathobiont content in the subject is reduced by at least 10%, 20%, 30%, 40%, 50%, 60%, 70%, 80%, 90%, 95%, 98%, 99% or greater than 99% following administration of the composition.

In some embodiments, the bacterial compositions comprise purified spore populations. Purified spore populations comprise one or more commensal bacteria of the human gut microbiota present in the form of a spore. Without being limited to a specific mechanism, it is thought that such compositions inhibit the growth of a pathogen such as *C. difficile*, *Salmonella* spp., enteropathogenic *E. coli*, and vancomycin-resistant *Enterococcus* spp., so that a healthy, diverse and protective microbiota can be maintained or, in the case of pathogenic bacterial infections such as *C. difficile* infection, repopulate the intestinal lumen to reestablish ecological control over potential pathogens.

In some embodiments, spore-forming bacteria are identified by the presence of nucleic acid sequences that modulate sporulation. In particular, signature sporulation genes are highly conserved across members of distantly related genera including *Clostridium* and *Bacillus*. Traditional approaches of forward genetics have identified many, if not all, genes that are essential for sporulation (spo). The developmental program of sporulation is governed in part by the successive action of four compartment-specific sigma factors (appearing in the order σF, σE, σG and σK), whose activities are confined to the forespore (σF and σG) or the mother cell (σE and σK).

Provided are bacterial compositions comprising more than one type of spore forming bacterium. As used herein, a "type" or more than one "types" of bacteria may be differentiated at the genus level, the species, level, the sub-species level, the strain level or by any other taxonomic method, as described herein and otherwise known in the art.

Pharmaceutical Compositions and Formulations of the Invention

Provided are formulations for administration to humans and other subjects in need thereof. Generally the bacterial compositions are combined with additional active and/or inactive materials in order to produce a final product, which may be in single dosage unit or in a multi-dose format.

In some embodiments, the composition comprises at least one carbohydrate. A "carbohydrate" refers to a sugar or polymer of sugars. The terms "saccharide," "polysaccharide," "carbohydrate," and "oligosaccharide" may be used interchangeably. Most carbohydrates are aldehydes or ketones with many hydroxyl groups, usually one on each carbon atom of the molecule. Carbohydrates generally have the molecular formula $C_nH_{2n}O_n$. A carbohydrate can be a monosaccharide, a disaccharide, trisaccharide, oligosaccharide, or polysaccharide. The most basic carbohydrate is a monosaccharide, such as glucose, sucrose, galactose, mannose, ribose, arabinose, xylose, and fructose. Disaccharides are two joined monosaccharides. Exemplary disaccharides include sucrose, maltose, cellobiose, and lactose. Typically, an oligosaccharide includes between three and six monosaccharide units (e.g., raffinose, stachyose), and polysaccharides include six or more monosaccharide units. Exemplary polysaccharides include starch, glycogen, and cellulose. Carbohydrates can contain modified saccharide units, such as 2'-deoxyribose wherein a hydroxyl group is removed, 2'-fluororibose wherein a hydroxyl group is replace with a fluorine, or N-acetylglucosamine, a nitrogen-containing form of glucose (e.g., 2'-fluororibose, deoxyribose, and hexose). Carbohydrates can exist in many different forms, for example, conformers, cyclic forms, acyclic forms, stereoisomers, tautomers, anomers, and isomers.

In some embodiments, the composition comprises at least one lipid. As used herein, a "lipid" includes fats, oils, triglycerides, cholesterol, phospholipids, fatty acids in any form including free fatty acids. Fats, oils and fatty acids can be saturated, unsaturated (cis or trans) or partially unsaturated (cis or trans). In some embodiments, the lipid comprises at least one fatty acid selected from lauric acid (12:0), myristic acid (14:0), palmitic acid (16:0), palmitoleic acid (16:1), margaric acid (17:0), heptadecenoic acid (17:1), stearic acid (18:0), oleic acid (18:1), linoleic acid (18:2), linolenic acid (18:3), octadecatetraenoic acid (18:4), arachidic acid (20:0), eicosenoic acid (20:1), eicosadienoic acid (20:2), eicosatetraenoic acid (20:4), eicosapentaenoic acid (20:5) (EPA), docosanoic acid (22:0), docosenoic acid (22:1), docosapentaenoic acid (22:5), docosahexaenoic acid (22:6) (DHA), and tetracosanoic acid (24:0). In other embodiments, the composition comprises at least one modified lipid, for example, a lipid that has been modified by cooking.

In some embodiments, the composition comprises at least one supplemental mineral or mineral source. Examples of minerals include, without limitation: chloride, sodium, calcium, iron, chromium, copper, iodine, zinc, magnesium, manganese, molybdenum, phosphorus, potassium, and selenium. Suitable forms of any of the foregoing minerals include soluble mineral salts, slightly soluble mineral salts, insoluble mineral salts, chelated minerals, mineral complexes, non-reactive minerals such as carbonyl minerals, and reduced minerals, and combinations thereof.

In certain embodiments, the composition comprises at least one supplemental vitamin. In one embodiment, at least one vitamin can be fat-soluble or water soluble vitamins. Suitable vitamins include but are not limited to vitamin C, vitamin A, vitamin E, vitamin B12, vitamin K, riboflavin, niacin, vitamin D, vitamin B6, folic acid, pyridoxine, thiamine, pantothenic acid, and biotin. Suitable forms of any of the foregoing are salts of the vitamin, derivatives of the vitamin, compounds having the same or similar activity of the vitamin, and metabolites of the vitamin.

In other embodiments, the composition comprises an excipient. Non-limiting examples of suitable excipients include a buffering agent, a preservative, a stabilizer, a binder, a compaction agent, a lubricant, a dispersion enhancer, a disintegration agent, a flavoring agent, a sweetener, and a coloring agent.

In another embodiment, the excipient is a buffering agent. Non-limiting examples of suitable buffering agents include sodium citrate, magnesium carbonate, magnesium bicarbonate, calcium carbonate, and calcium bicarbonate.

In some embodiments, the excipient comprises a preservative. Non-limiting examples of suitable preservatives include antioxidants, such as alpha-tocopherol and ascorbate, and antimicrobials, such as parabens, chlorobutanol, and phenol.

In other embodiments, the composition comprises a binder as an excipient. Non-limiting examples of suitable binders include starches, pregelatinized starches, gelatin, polyvinylpyrolidone, cellulose, methylcellulose, sodium carboxymethylcellulose, ethylcellulose, polyacrylamides, polyvinyloxoazolidone, polyvinylalcohols, $C_{12}$-$C_{18}$ fatty acid alcohol, polyethylene glycol, polyols, saccharides, oligosaccharides, and combinations thereof.

In another embodiment, the composition comprises a lubricant as an excipient. Non-limiting examples of suitable lubricants include magnesium stearate, calcium stearate, zinc stearate, hydrogenated vegetable oils, sterotex, polyoxyethylene monostearate, talc, polyethyleneglycol, sodium benzoate, sodium lauryl sulfate, magnesium lauryl sulfate, and light mineral oil.

In other embodiments, the composition comprises a dispersion enhancer as an excipient. Non-limiting examples of suitable dispersants include starch, alginic acid, polyvinylpyrrolidones, guar gum, kaolin, bentonite, purified wood cellulose, sodium starch glycolate, isoamorphous silicate, and microcrystalline cellulose as high HLB emulsifier surfactants.

In some embodiments, the composition comprises a disintegrant as an excipient. In other embodiments, the disintegrant is a non-effervescent disintegrant. Non-limiting examples of suitable non-effervescent disintegrants include starches such as corn starch, potato starch, pregelatinized and modified starches thereof, sweeteners, clays, such as bentonite, micro-crystalline cellulose, alginates, sodium starch glycolate, gums such as agar, guar, locust bean, karaya, pecitin, and tragacanth. In another embodiment, the disintegrant is an effervescent disintegrant. Non-limiting examples of suitable effervescent disintegrants include sodium bicarbonate in combination with citric acid, and sodium bicarbonate in combination with tartaric acid.

In another embodiment, the excipient comprises a flavoring agent. Flavoring agents can be chosen from synthetic flavor oils and flavoring aromatics; natural oils; extracts from plants, leaves, flowers, and fruits; and combinations thereof. In some embodiments the flavoring agent is selected from cinnamon oils; oil of wintergreen; peppermint oils; clover oil; hay oil; anise oil; eucalyptus; vanilla; citrus oil such as lemon oil, orange oil, grape and grapefruit oil; and fruit essences including apple, peach, pear, strawberry, raspberry, cherry, plum, pineapple, and apricot.

In other embodiments, the excipient comprises a sweetener. Non-limiting examples of suitable sweeteners include glucose (corn syrup), dextrose, invert sugar, fructose, and mixtures thereof (when not used as a carrier); saccharin and its various salts such as the sodium salt; dipeptide sweeteners such as aspartame; dihydrochalcone compounds, glycyrrhizin; *Stevia Rebaudiana* (Stevioside); chloro derivatives of sucrose such as sucralose; and sugar alcohols such as sorbitol, mannitol, sylitol, and the like. Also contemplated are hydrogenated starch hydrolysates and the synthetic sweetener 3,6-dihydro-6-methyl-1,2,3-oxathiazin-4-one-2,2-dioxide, particularly the potassium salt (acesulfame-K), and sodium and calcium salts thereof.

In yet other embodiments, the composition comprises a coloring agent. Non-limiting examples of suitable color agents include food, drug and cosmetic colors (FD&C), drug and cosmetic colors (D&C), and external drug and cosmetic colors (Ext. D&C). The coloring agents can be used as dyes or their corresponding lakes.

The weight fraction of the excipient or combination of excipients in the formulation is usually about 99% or less, such as about 95% or less, about 90% or less, about 85% or less, about 80% or less, about 75% or less, about 70% or less, about 65% or less, about 60% or less, about 55% or less, 50% or less, about 45% or less, about 40% or less, about 35% or less, about 30% or less, about 25% or less, about 20% or less, about 15% or less, about 10% or less, about 5% or less, about 2% or less, or about 1% or less of the total weight of the composition.

The bacterial compositions disclosed herein can be formulated into a variety of forms and administered by a number of different means. The compositions can be administered orally, rectally, or parenterally, in formulations containing conventionally acceptable carriers, adjuvants, and vehicles as desired. The term "parenteral" as used herein includes subcutaneous, intravenous, intramuscular, or intrasternal injection and infusion techniques. In an exemplary embodiment, the bacterial composition is administered orally.

Solid dosage forms for oral administration include capsules, tablets, caplets, pills, troches, lozenges, powders, and granules. A capsule typically comprises a core material comprising a bacterial composition and a shell wall that encapsulates the core material. In some embodiments, the core material comprises at least one of a solid, a liquid, and an emulsion. In other embodiments, the shell wall material comprises at least one of a soft gelatin, a hard gelatin, and a polymer. Suitable polymers include, but are not limited to: cellulosic polymers such as hydroxypropyl cellulose, hydroxyethyl cellulose, hydroxypropyl methyl cellulose (HPMC), methyl cellulose, ethyl cellulose, cellulose acetate, cellulose acetate phthalate, cellulose acetate trimellitate, hydroxypropylmethyl cellulose phthalate, hydroxypropylmethyl cellulose succinate and carboxymethylcellulose sodium; acrylic acid polymers and copolymers, such as those formed from acrylic acid, methacrylic acid, methyl acrylate, ammonio methylacrylate, ethyl acrylate, methyl methacrylate and/or ethyl methacrylate (e.g., those copolymers sold under the trade name "Eudragit"); vinyl polymers and copolymers such as polyvinyl pyrrolidone, polyvinyl acetate, polyvinylacetate phthalate, vinylacetate crotonic acid copolymer, and ethylene-vinyl acetate copolymers; and shellac (purified lac). In yet other embodiments, at least one polymer functions as taste-masking agents.

Tablets, pills, and the like can be compressed, multiply compressed, multiply layered, and/or coated. The coating can be single or multiple. In one embodiment, the coating material comprises at least one of a saccharide, a polysaccharide, and glycoproteins extracted from at least one of a plant, a fungus, and a microbe. Non-limiting examples include corn starch, wheat starch, potato starch, tapioca starch, cellulose, hemicellulose, dextrans, maltodextrin, cyclodextrins, inulins, pectin, mannans, gum arabic, locust bean gum, mesquite gum, guar gum, gum karaya, gum ghatti, tragacanth gum, funori, carrageenans, agar, alginates, chitosans, or gellan gum. In some embodiments the coating material comprises a protein. In another embodiment, the coating material comprises at least one of a fat and an oil. In other embodiments, the at least one of a fat and an oil is high temperature melting. In yet another embodiment, the at least one of a fat and an oil is hydrogenated or partially hydrogenated. In one embodiment, the at least one of a fat and an oil is derived from a plant. In other embodiments, the at least one of a fat and an oil comprises at least one of glycerides, free fatty acids, and fatty acid esters. In some embodiments, the coating material comprises at least one edible wax. The edible wax can be derived from animals, insects, or plants. Non-limiting examples include beeswax, lanolin, bayberry wax, carnauba wax, and rice bran wax. Tablets and pills can additionally be prepared with enteric coatings.

Alternatively, powders or granules embodying the bacterial compositions disclosed herein can be incorporated into a food product. In some embodiments, the food product is a drink for oral administration. Non-limiting examples of a suitable drink include fruit juice, a fruit drink, an artificially flavored drink, an artificially sweetened drink, a carbonated beverage, a sports drink, a liquid diary product, a shake, an alcoholic beverage, a caffeinated beverage, infant formula and so forth. Other suitable means for oral administration include aqueous and nonaqueous solutions, emulsions, suspensions and solutions and/or suspensions reconstituted from non-effervescent granules, containing at least one of suitable solvents, preservatives, emulsifying agents, suspending agents, diluents, sweeteners, coloring agents, and flavoring agents.

In some embodiments, the food product can be a solid foodstuff. Suitable examples of a solid foodstuff include without limitation a food bar, a snack bar, a cookie, a brownie, a muffin, a cracker, an ice cream bar, a frozen yogurt bar, and the like.

In other embodiments, the compositions disclosed herein are incorporated into a therapeutic food. In some embodiments, the therapeutic food is a ready-to-use food that optionally contains some or all essential macronutrients and micronutrients. In another embodiment, the compositions disclosed herein are incorporated into a supplementary food that is designed to be blended into an existing meal. In one embodiment, the supplemental food contains some or all essential macronutrients and micronutrients. In another embodiment, the bacterial compositions disclosed herein are blended with or added to an existing food to fortify the food's protein nutrition. Examples include food staples (grain, salt, sugar, cooking oil, margarine), beverages (coffee, tea, soda, beer, liquor, sports drinks), snacks, sweets and other foods.

In one embodiment, the formulations are filled into gelatin capsules for oral administration. An example of an appropriate capsule is a 250 mg gelatin capsule containing from 10 (up to 100 mg) of lyophilized powder ($10^8$ to $10^{11}$ bacteria), 160 mg microcrystalline cellulose, 77.5 mg gelatin, and 2.5 mg magnesium stearate. In an alternative embodiment, from $10^5$ to $10^{12}$ bacteria may be used, $10^5$ to $10^7$, $10^6$ to $10^7$, or $10^8$ to $10^{10}$, with attendant adjustments of the excipients if necessary. In an alternative embodiment, an enteric-coated capsule or tablet or with a buffering or protective composition can be used.

Methods of the Invention

Administration of Bacterial Compositions

The bacterial compositions of the invention are suitable for administration to mammals and non-mammalian animals in need thereof. The bacterial compositions can be administered to animals, including humans, laboratory animals (e.g., primates, rats, mice), livestock (e.g., cows, sheep, goats, pigs, turkeys, chickens), and household pets (e.g., dogs, cats, rodents). In certain embodiments, the mammalian subject is a human subject who has one or more symptoms of a dysbiosis.

When the mammalian subject is suffering from a disease, disorder or condition characterized by an aberrant microbiota, the bacterial compositions described herein are suitable for treatment thereof. In some embodiments, the mammalian subject has not received antibiotics in advance of treatment with the bacterial compositions. For example, the mammalian subject has not been administered at least two doses of vancomycin, metronidazole and/or or similar antibiotic compound within one week prior to administration of the therapeutic composition. In other embodiments, the mammalian subject has not previously received an antibiotic compound in the one month prior to administration of the therapeutic composition.

The bacterial compositions are useful in methods of treating a mammalian subject suffering from or at risk of developing a gastrointestinal disease, disorder or condition. Therefore, a therapeutic benefit is provided by orally administering to the mammalian subject a therapeutic composition containing a bacterial population comprising at least three bacterial strains, wherein each bacterial strain is a member of a bacterial species selected from the group consisting of *E. coli, S. faecalis, C. ramosum, C. bifermentans, Bact. ovatus, Bact. vulgatus, Bact. thetaiotaomicron*, and *Blautia producta*, wherein the therapeutic composition is formulated for oral administration. In some embodiments, the gastrointestinal disease, disorder or condition is relapsing diarrhea caused by *C. difficile*, ulcerative colitis, colitis, Crohn's disease, or irritable bowel disease. Beneficially, the therapeutic composition is administered only once prior to improvement of the disease, disorder or condition. In some embodiments the therapeutic composition is administered at intervals greater than two days, such as once every three, four, five or six days, or every week or less frequently than every week.

Also provided are methods of treating or preventing a mammalian subject suffering from or at risk of developing a metabolic disease, disorder or condition selected from the group consisting of diabetes, metabolic syndrome, obesity, and autism using the therapeutic compositions provided herein. The bacterial compositions can be administered as a complementary treatment to antibiotics when a patient is suffering from an acute infection, to reduce the risk of recurrence after an acute infection has subsided, or when a patient will be in close proximity to others with or at risk of serious gastrointestinal infections (physicians, nurses, hospital workers, family members of those who are ill or hospitalized).

An In Vivo Assay Establishing that a Bacterial Composition Populates a Subject's Gastrointestinal Tract In order to determine that the bacterial composition populates the gastrointestinal tract of a subject, an animal model, such as a mouse model, may be used. The model may begin by evaluating the microbiota of the mice. Qualitative assessments may be accomplished using 16S profiling of the microbial community in the feces of normal mice. It may also be accomplished by full genome sequencing, whole genome shotgun sequencing (WGS), or traditional microbiological techniques. Quantitative assessments may be conducted using quantitative PCR (qPCR), described in section below, or by using traditional microbiological techniques and counting colony formation.

Optionally, the mice may receive an antibiotic treatment to mimic the condition of dysbiosis. Antibiotic treatment can decrease the taxonomic richness, diversity, and evenness of the community, including a reduction of abundance of a significant number of bacterial taxa. Dethlefsen et al., The pervasive effects of an antibiotic on the human gut microbiota, as revealed by deep 16S rRNA sequencing, PLoS Biology 6(11):3280 (2008). At least one antibiotic may be used and antibiotics are well known. Antibiotics may include aminoglycoside antibiotics (amikacin, arbekacin, gentamicin, kanamycin, neomycin, netilmicin, paromomycin, rhodostreptomycin, streptomycin, tobramycin, and apramycin), amoxicillin, ampicillin, Augmentin (an amoxicillin/clavulanate potassium combination), cephalosporin (cefaclor, defadroxil, cefazolin, cefixime, fefoxitin, cefprozil, ceftazimdime, cefuroxime, cephalexin), clavulanate potassium, clindamycin, colistin, gentamycin, kanamycin, metronidazole, or vancomycin. As an individual, nonlimiting specific example, the mice may be provided with drinking water containing a mixture of the antibiotics kanamycin, colistin, gentamycin, metronidazole and vancomycin at 40 mg/kg, 4.2 mg/kg, 3.5 mg/kg, 21.5 mg/kg, and 4.5 mg/kg (mg per average mouse body weight), respectively, for 7 days. Alternatively, mice may be administered ciprofloxacin at a dose of 15-20 mg/kg (mg per average mouse body weight), for 7 days.

If the mice are provided with an antibiotic, a wash out period of from one day to three days may be provided with no antibiotic treatment and no bacterial composition treatment.

Subsequently, the test bacterial composition is administered to the mice by oral gavage. The test bacterial composition may be administered in a volume of 0.2 ml containing $10^4$ CFUs of each type of bacteria in the bacterial composition. Dose-response may be assessed by using a range of doses, including, but not limited to $10^2$, $10^3$, $10^4$, $10^5$, $10^6$, $10^7$, $10^8$, $10^9$, and/or $10^{10}$.

The mice may be evaluated using 16S sequencing, full genome sequencing, whole genome shotgun sequencing (WGS), or traditional microbiological techniques to determine whether the test bacterial composition has populated the gastrointestinal tract of the mice. For example only, one day, three days, one week, two weeks, and one month after administration of the bacterial composition to the mice, 16S profiling is conducted to determine whether the test bacterial composition has populated the gastrointestinal tract of the mice. Quantitative assessments, including qPCR and traditional microbiological techniques such as colony counting, may additionally or alternatively be performed, at the same time intervals.

Furthermore, the number of sequence counts that correspond exactly to those in the bacterial composition over time may be assessed to determine specifically which components of the bacterial composition reside in the gastrointestinal tract over a particular period of time. In one embodiment, the strains of the bacterial composition persist for a desired period of time; in another embodiment, the components of the bacterial composition persist for a desired period of time while also increasing the ability of other microbes (such as those present in the environment, food, etc.) to populate the gastrointestinal tract, further increasing overall diversity, as discussed below.

Ability of Bacterial cCompositions to Populate Different Regions of the Gastrointestinal Tract The present bacterial compositions may also be assessed for their ability to populate different regions on the gastrointestinal tract. In one embodiment, a bacterial composition may be chosen for its ability to populate one or more than one region of the gastrointestinal tract, including, but not limited to the stomach, the small intestine (duodenum, jejunum, and ileum), the large intestine (the cecum, the colon (the ascending, transverse, descending, and sigmoid colon), and the rectum).

An in vivo study may be conducted to determine which regions of the gastrointestinal tract a given bacterial composition will populate. A mouse model similar to the one described above in section II.A may be conducted, except instead of assessing the feces produced by the mice, particular regions of the gastrointestinal tract may be removed and studied individually. For example, at least one particular region of the gastrointestinal tract may be removed and a qualitative or quantitative determination may be performed on the contents of that region of the gastrointestinal tract. In another embodiment, the contents may optionally be removed and the qualitative or quantitative determination may be conducted on the tissue removed from the mouse.

Methods for Testing Sensitivity of Bacterial Composition

In certain embodiments, methods for testing the sensitivity of bacterial compositions in order to select for particular desirable characteristics may be employed. For example, the constituents in the bacterial composition may be tested for pH resistance, bile acid resistance, and/or antibiotic sensitivity, either individually on a constituent-by-constituent basis or collectively as a bacterial composition comprised of multiple bacterial constituents (collectively referred to in this section as bacterial composition).

1. pH Sensitivity Testing

For oral administration of the bacterial compositions, optionally testing for pH resistance enhances the selection of bacterial compositions that will survive at the highest yield possible through the varying pH environments of the distinct regions of the GI tract. Understanding how the bacterial compositions react to the pH of the GI tract also assists in formulation, so that the number of bacteria in a dosage form can be increased if beneficial and/or so that the composition may be administered in an enteric-coated capsule or tablet or with a buffering composition. As the pH of the stomach can drop to a pH of 1 to 2 after a high-protein meal for a short time before physiological mechanisms adjust it to a pH of 3 to 4 and often resides at a resting pH of 4 to 5, and as the pH of the small intestine can range from a pH of 6 to 7.4, bacterial compositions can be prepared that survive these varying pH ranges (specifically wherein at least 1%, 5%, 10%, 15%, 20%, 25%, 30%, 40%, 50%, 60%, 70%, 80%, 90%, or as much as 100% of the bacteria can survive gut transit times through various pH ranges).

This may be tested by exposing the bacterial composition to varying pH ranges for the expected gut transit times through those pH ranges. Therefore, as a nonlimiting example only, 18-hour cultures of bacterial compositions may be grown in standard media, such as gut microbiota medium ("GMM", see Goodman et al., Extensive personal human gut microbiota culture collections characterized and manipulated in gnotobiotic mice, PNAS 108(15):6252-6257 (2011)) or another animal-products-free medium, with the addition of pH adjusting agents for a pH of 1 to 2 for 30 minutes, a pH of 3 to 4 for 1 hour, a pH of 4 to 5 for 1 to 2 hours, and a pH of 6 to 7.4 for 2.5 to 3 hours.

Alternatively, bacterial cells may be grown in a standard media, such as the GMM media described above, and adjusted to pH 2.5 with 1M HCl. The cells may be incubated anaerobically at 37° C. and their survival measured at intervals of 0, 30, 60, 120, 240, and/or 360 minutes.

A further alternative method for testing stability to acid is described in U.S. Pat. No. 4,839,281.

Survival of bacteria may be determined by culturing the bacteria and counting colonies on appropriate selective or non-selective media.

2. Bile Acid Sensitivity Testing

Additionally, in some embodiments, testing for bile-acid resistance enhances the selection of bacterial compositions that will survive exposures to bile acid during transit through the GI tract. Bile acids are secreted into the small intestine and can, like pH, affect the survival of bacterial compositions.

This may be tested by exposing the bacterial compositions to bile acids for the expected gut exposure time to bile acids. For example, bile acid solutions may be prepared at desired concentrations using 0.05 mM Tris at pH 9 as the solvent. After the bile acid is dissolved, the pH of the solution may be adjusted to 7.2 with 10% HCl. Bacterial compositions may be cultured in 2.2 ml of a bile acid composition mimicking the concentration and type of bile acids in the subject, 1.0 ml of 10% sterile-filtered feces media and 0.1 ml of an 18-hour culture of the given strain of bacteria. Incubations may be conducted for from 2.5 to 3 hours or longer. Survival of bacteria may be determined by culturing the bacteria and counting colonies on appropriate selective or non-selective media.

As another alternative, bacterial strains may be streaked onto agar plates supplemented with porcine bile (Sigma) at 0.5%, 1%, and 5% (w/v). Plates may be incubated at 37° C. under anaerobic conditions and the growth recorded after 48 hours. Growth may be compared with control plates by an experienced observer and the growth of colonies scored as: 0=no growth, 1=hazy translucent growth (<33% control plates with 0% bile), 2=definite growth but not as good as controls (>33% but <66%), 3=growth equivalent to controls (>66%).

A further alternative method for testing stability to bile acid is described in U.S. Pat. No. 4,839,281. Survival of bacteria may be determined by culturing the bacteria and counting colonies on appropriate selective or non-selective media.

3. Antibiotic Sensitivity Testing

As a further optional sensitivity test, bacterial compositions may be tested for sensitivity to antibiotics. In one embodiment, bacterial compositions may be chosen so that the bacterial constituents are sensitive to antibiotics such that if necessary they can be eliminated or substantially reduced from the subject's gastrointestinal tract by at least one antibiotic targeting the bacterial composition.

4. Adherence to Gastrointestinal Cells

The bacterial compositions may optionally be tested for the ability to adhere to gastrointestinal cells. Without being bound by theory, in some instances, adherence can enhance the ability to repopulate a subject's gastrointestinal tract and thus may be used as a criterion in some embodiments. As a first embodiment, this may be conducted in a tissue culture model, where gastrointestinal epithelial cells, such as but not limited to CACO-2 cells (ATCC HTB-37), are grown in tissue culture flasks to differentiation in an antibiotic containing media, grown for at least 1, at least 2, at least 3, at least 4, at least 5, at least 6, or at least 7 days in an antibiotic-free medium, incubated with bacterial cells for 30 minutes, 60 minutes, 90 minutes, or 120 minutes, and washed three times. After washing, the number of adherent bacteria may be assessed by lysing the epithelial cells and enumerating the bacteria using the plate count method or qPCR, as described herein.

As another mode, bacterial adherence may be evaluated using an engineered tissue model of the lining of the gastrointestinal tract. Viney et al., "Co-culture of Intestinal Epithelial and Stromal Cells in 3D Collagen-based Environments," Regen Med 4(3):397-406 (2009). After preparation of the engineered tissue model, the bacterial cells may be incubated, washed, and adherence enumerated, as described above.

Furthermore, bacterial adherence may be evaluated using a tissue explant from the gastrointestinal tract of a subject. Gastrointestinal tract tissue may be surgically removed from a healthy donor. Alternatively, gastrointestinal tract tissue may be surgically removed from a donor who has a gastrointestinal disease, such as from an unused portion of a biopsy. After surgical excision, the bacterial cells may be incubated, washed, and adherence enumerated, as described above.

As an alternative, one technique involves the collection of the effluent from a subject with a well functioning ileostomy by saline lavage, as described in U.S. Pat. No. 4,839,281.

Assessment of Microbiota Diversity

Microbiota diversity, as assessed by deep 16S rRNA sequencing or metagenomic sequencing, may be evaluated at a variety of time points to assess the effect of microbial compositions on restoring microbiota diversity. Microbial diversity may optionally be assessed before administration of an antibiotic or removal of microbiota by a colon-cleansing preparation. Microbial diversity may also be assessed before administration of a microbial composition and after administration of a microbial composition at any frequency (e.g., more frequently than 1 day, 1 day, 3 days, 1 week, 2 weeks, one month, or more than one month). One may provide for any temporal resolution that has more or less frequent sampling intervals, and/or samples taken for a longer time period (e.g., at least 1 week, at least 1 month, at least three months, at least six months, at least 1, 2, 3, 4, 5, 6, 7, 8, 9, 10 or over more than 10 years.

Diversity may be measured according to known sequencing methods, including, but not limited to Dethlefsen et al., The pervasive effects of an antibiotic on the human gut microbiota, as revealed by deep 16S rRNA sequencing, PLoS Biology 6(11):3280 (2008). Sequence data used for diversity analysis may comprise 16S rRNA, whole genome sequence, any subset of a genome as well as whole genome shotgun metagenomic sequence (WGS). Sequence data may be generated using any sequencing technology including, but not limited to Sanger, Illumina, 454 Life Sciences, Ion Torrent, ABI, Pacific Bioscienses, and/or Oxford Nanopore. Subjects may be assessed for a variety of diversity metrics, including, but not limited to, observed taxon richness, Shannon diversity index, Shannon equitability index, alpha diversity, beta diversity, Chao1 index, Simpson diversity index, normalized abundance over time, and/or phylogenetic breadth.

In another embodiment, subjects may be assessed for a variety of diversity metrics, including, but not limited to, Simpson diversity or by plotting rarefaction curve comparisons of reference OTUs for subjects before and after treatment with microbial compositions. Phylogenetic diversity may be plotted against the number of sequence reads (full 16S sequence or one or any combination of more hypervariable regions of the 16S sequence, whole genome sequence, or specific marker loci). Shahinas, et al., Toward an understanding of changes in diversity associated with fecal microbiome transplantation based on 16S rRNA Gene Deep Sequencing, mBio 3(5):e00338-12 (2012).

In another embodiment, diversity may be shown by graphing a bar plot of abundance at the family level and showing an increase in either the number of families or the balance of abundance between families.

In another embodiment, diversity may be shown by plotting heatmaps of the abundance of an OTU, species, genus, and/or higher taxonomic assignment showing sets of samples that are enriched or depleted for specific constituents.

In another embodiment, diversity may be shown by generation of a phylogenetic tree of OTUs, species, genera, and/or higher or lower clade assignments. In this embodiment genetic distances may be computed between all OTUs, and summary statistics including, but not limited to average genetic distance and number of unique clades may be computed.

In another embodiment, beta-diversity may be computed using diversity metrics familiar to those with ordinary skill in the art that include but are not limited to Bray-Curtis Dissimilarity Indices or Jaccard Distances and plotted using Principal Coordinates Analysis.

Beneficial bacterial compositions may result in an increase in diversity after their administration that is 10%, 20%, 30%, 40%, or 50% higher than diversity before their administration. In another embodiment bacterial compositions may result in restoration of diversity to at least 70%, 80%, 90%, 95%, or up to 100% of the diversity either measured before administration of an antibiotic or removal of microbiota by a colon-cleansing preparation, or alternatively, as compared to the diversity of a reference mammalian subject.

Methods for Preparing a Bacterial Composition for Administration to a Subject

Methods for producing bacterial compositions may include three main processing steps, combined with one or more mixing steps. The steps are: organism banking, organism production, and preservation.

For banking, the strains included in the bacterial composition may be (1) isolated directly from a specimen or taken from a banked stock, (2) optionally cultured on a nutrient agar or broth that supports growth to generate viable biomass, and (3) the biomass optionally preserved in multiple aliquots in long-term storage.

In embodiments using a culturing step, the agar or broth may contain nutrients that provide essential elements and specific factors that enable growth. An example would be a medium composed of 20 g/L glucose, 10 g/L yeast extract, 10 g/L soy peptone, 2 g/L citric acid, 1.5 g/L sodium phosphate monobasic, 100 mg/L ferric ammonium citrate, 80 mg/L magnesium sulfate, 10 mg/L hemin chloride, 2 mg/L calcium chloride, 1 mg/L menadione. Medium can be added to the culture at the start, may be added during the culture, or may be intermittently/continuously flowed through the culture. The strains in the bacterial composition may be cultivated alone, as a subset of the bacterial composition, or as an entire collection comprising the bacterial composition. As an example, a first strain may be cultivated together with a second strain in a mixed continuous culture, at a dilution rate lower than the maximum growth rate of either cell to prevent the culture from washing out of the cultivation.

The inoculated culture is incubated under favorable conditions for a time sufficient to build biomass. For bacterial compositions for human use this is often at 37° C. temperature, pH, and other parameter with values similar to the normal human niche. The environment may be actively controlled, passively controlled (e.g., via buffers), or allowed to drift. For example, for anaerobic bacterial compositions (e.g., gut applications), an anoxic/reducing environment may be employed. This can be accomplished by addition of reducing agents such as cysteine to the broth, and/or stripping it of oxygen. As an example, a culture of a bacterial composition may be grown at 37° C., pH 7, in the medium above, pre-reduced with 1 g/L cysteineŸHCl.

When the culture has generated sufficient biomass, it may be preserved for banking. The organisms may be placed into a chemical milieu that protects from freezing (adding 'cryoprotectants'), drying ('lyoprotectants'), and/or osmotic shock ('osmoprotectants'), dispensing into multiple (optionally identical) containers to create a uniform bank, and then treating the culture for preservation. Containers are generally impermeable and have closures that assure isolation from the environment. Cryopreservation treatment is accomplished by freezing a liquid at ultra-low temperatures (e.g., at or below −80° C.). Dried preservation removes water from the culture by evaporation (in the case of spray drying or 'cool drying') or by sublimation (e.g., for freeze drying, spray freeze drying). Removal of water improves long-term bacterial composition storage stability at temperatures elevated above cryogenic. Bacterial composition banking may be done by culturing and preserving the strains individually, or by mixing the strains together to create a combined bank. As an example of cryopreservation, a bacterial composition culture may be harvested by centrifugation to pellet the cells from the culture medium, the supernatant decanted and replaced with fresh culture broth containing 15% glycerol. The culture can then be aliquoted into 1 mL cryotubes, sealed, and placed at −80° C. for long-term viability retention. This procedure achieves acceptable viability upon recovery from frozen storage.

Organism production may be conducted using similar culture steps to banking, including medium composition and culture conditions. It may be conducted at larger scales of operation, especially for clinical development or commercial production. At larger scales, there may be several subcultivations of the bacterial composition prior to the final cultivation. At the end of cultivation, the culture is harvested to enable further formulation into a dosage form for administration. This can involve concentration, removal of undesirable medium components, and/or introduction into a chemical milieu that preserves the bacterial composition and renders it acceptable for administration via the chosen route. For example, a bacterial composition may be cultivated to a concentration of $10^{10}$ CFU/mL, then concentrated 20-fold by tangential flow microfiltration; the spent medium may be exchanged by diafiltering with a preservative medium consisting of 2% gelatin, 100 mM trehalose, and 10 mM sodium phosphate buffer. The suspension can then be freeze-dried to a powder and titrated. After drying, the powder may be blended to an appropriate potency, and mixed with other cultures and/or a 'filler' such as microcrystalline cellulose for consistency and ease of handling, and the bacterial composition filled into gelatin capsules for oral administration.

An example of an appropriate capsule is a 250 mg gelatin capsule containing from 10 (up to 100 mg) of lyophilized powder ($10^8$ to $10^{11}$ bacteria), 160 mg microcrystalline cellulose, 77.5 mg gelatin, and 2.5 mg magnesium stearate. In an alternative embodiment, from $10^5$ to $10^{12}$ bacteria may be used, $10^5$ to $10^7$, $10^6$ to $10^7$, or $10^8$ to $10^{10}$, with attendant adjustments of the excipients if necessary.

In one embodiment, the number of bacteria of each type may be present in the same amount or in different amounts. For example, in a bacterial composition with two types of bacteria, the bacteria may be present in from a 1:10,000 ratio to a 1:1 ratio, from a 1:10,000 ratio to a 1:1,000 ratio, from a 1:1,000 ratio to a 1:100 ratio, from a 1:100 ratio to a 1:50 ratio, from a 1:50 ratio to a 1:20 ratio, from a 1:20 ratio to a 1:10 ratio, from a 1:10 ratio to a 1:1 ratio. For bacterial compositions comprising at least three types of bacteria, the ratio of type of bacteria may be chosen pairwise from ratios for bacterial compositions with two types of bacteria. For example, in a bacterial composition comprising bacteria A, B, and C, at least one of the ratio between bacteria A and B, the ratio between bacteria B and C, and the ratio between bacteria A and C may be chosen, independently, from the pairwise combinations above.

Methods of Treating a Subject

A. Overview of Method

The bacterial compositions may be used to populate the gastrointestinal tract of a subject, resulting in one or more of a changed constitution of a subject's microbiota and improvement or correction of a dysbiosis. Without being bound by theory, bacterial compositions can promote mammalian health by restoring the natural microflora in the GI tract and reinforcing the normal controls on aberrant immune responses.

Bacterial compositions can also improve fiber and protein digestion. Improving fiber and protein digestion is desirable as it promotes the growth of microbiota. A probiotic composition with multiple species has been shown to reduce production of toxic metabolites from protein fermentation. Rehman, Effects of Probiotics and antibiotics on intestinal homeostasis in a computer controlled model of the large intestine, BMC Microbiology 12:47 (2012). Carbohydrate fermentation is, for the most part, believed to be a beneficial process in the large gut, because the growth of saccharolytic bacteria stimulates their requirements for toxic products associated with putrefaction, for incorporation into cellular proteins, thereby protecting the host. However, as digestive materials move along the gut, carbohydrates become depleted, which may be linked to the increased prevalence of colonic disease in the distal bowel. Macfarlane, et al., Bacteria, colonic fermentation, and gastrointestinal health, J AOAC Int. 95(1):50-60 (2012). Thus, restoring microbiota, including, but not limited to, restoring microbiota in the distal bowel can provide health benefits.

Fiber digestion may be determined using the method described in Vickers et al., Comparison of fermentation of selected fructooligosaccharides and other fiber substrates by canine colonic microflora, Am. J. Vet. Res. 61 (4), 609-615 (2001), with the exception that instead of inoculating using diluted fecal samples each experiment may use the bacterial compositions of interest.

In one embodiment, the pathogen may be *Clostridium difficile, Salmonella* spp., pathogenic *Escherichia coli*, or vancomycin-resistant *Enterococcus* spp. In yet another embodiment, the pathogen may be *Clostridium difficile*, or other pathogen or pathobiont listed in Table 1.

The present bacterial compositions may be useful in a variety of clinical situations. For example, the bacterial compositions may be administered as a complementary treatment to antibiotics when a subject is suffering from an acute infection, to reduce the risk of recurrence after an acute infection has subsided, or when a subject will be in close proximity to others with or at risk of serious gastrointestinal infections (physicians, nurses, hospital workers, family members of those who are ill or hospitalized).

The present bacterial compositions may be administered to animals, including humans, laboratory animals (e.g., primates, rats, mice), livestock (e.g., cows, sheep, goats, pigs, turkeys, chickens), and household pets (e.g., dogs, cats, rodents).

In the present method, the bacterial composition is administered enterically, in other words by a route of access to the gastrointestinal tract. This includes oral administration, rectal administration (including enema, suppository, or colonoscopy), by an oral or nasal tube (nasogastric, nasojejunal, oral gastric, or oral jejunal), as detailed more fully in the section below.

B. Pretreatment Protocols

Prior to administration of the bacterial composition, the subject may optionally have a pretreatment protocol to prepare the gastrointestinal tract to receive the bacterial composition. In certain embodiments, the pretreatment protocol is advisable, such as when a subject has an acute infection with a highly resilient pathogen or when the microbiota resident in the subject's gastrointestinal tract is likely to resist colonization by the bacterial composition. In other embodiments, the pretreatment protocol is entirely optional, such as when the dysbiosis is not associated with a pathogenic infection; when, if an infection is present, the pathogen causing the infection is not resilient, or when the subject has had an acute infection that has been successfully treated but where the physician is concerned that the infection may recur. In these instances, the pretreatment protocol may enhance the ability of the bacterial composition to affect the subject's microbiome.

As one way of preparing the subject for administration of the microbial ecosystem, a standard colon-cleansing preparation may be administered to the subject to substantially empty the contents of the colon, such as used to prepare a subject for a colonoscopy. By "substantially emptying the contents of the colon," this application means removing at least 75%, at least 80%, at least 90%, at least 95%, or about 100% of the contents of the ordinary volume of colon contents.

If a subject has received an antibiotic for treatment of an infection, or if a subject has received an antibiotic as part of a specific pretreatment protocol, in one embodiment the antibiotic should be stopped in sufficient time to allow the antibiotic to be substantially reduced in concentration in the gut before the bacterial composition is administered. In one embodiment, the antibiotic may be discontinued 1, 2, or 3 days before the administration of the bacterial composition. In one embodiment, the antibiotic may be discontinued 3, 4, 5, 6, or 7 antibiotic half-lives before administration of the bacterial composition. In another embodiment, the antibiotic may be chosen so the constituents in the bacterial composition have an MIC50 that is higher than the concentration of the antibiotic in the gut.

MIC50 of a bacterial composition or the elements in the composition may be determined by methods well known in the art. Reller et al., Antimicrobial Susceptibility Testing: A Review of General Principles and Contemporary Practices, Clinical Infectious Diseases 49(11):1749-1755 (2009). In such an embodiment, the additional time between antibiotic administration and administration of the bacterial composition is not necessary. If the pretreatment protocol is part of treatment of an acute infection, the antibiotic may be chosen so that the infection is sensitive to the antibiotic, but the constituents in the bacterial composition are not sensitive to the antibiotic.

C. Routes of Administration

In the present method, the bacterial composition is administered enterically, in other words by a route of access to the gastrointestinal tract. This preferentially includes oral administration, or by an oral or nasal tube (including nasogastric, nasojejunal, oral gastric, or oral jejunal). In other embodiments, administration includes rectal administration (including enema, suppository, or colonoscopy). The bacterial composition may be administered to at least one region of the gastrointestinal tract, including the mouth, esophagus, stomach, small intestine, large intestine, and rectum. In some embodiments it is administered to all regions of the gastrointestinal tract. The bacterial compositions may be administered orally in the form of medicaments such as powders, capsules, tablets, gels or liquids. The bacterial compositions may also be administered in gel or liquid form by the oral route or through a nasogastric tube, or by the rectal route in a gel or liquid form, by enema or instillation through a colonoscope or by a suppository.

If the composition is administered colonoscopically and, optionally, if the bacterial composition is administered by other rectal routes (such as an enema or suppository) or even if the subject has an oral administration, the subject may have a colonic-cleansing preparation. The colon-cleansing preparation can facilitate proper use of the colonoscope or other administration devices, but even when it does not serve a mechanical purpose it can also maximize the proportion of the bacterial composition relative to the other organisms previously residing in the gastrointestinal tract of the subject. Any ordinarily acceptable colonic-cleansing preparation may be used such as those typically provided when a subject undergoes a colonoscopy.

D. Dosages and Schedule for Administration

In one embodiment, from $10^8$ and $10^{11}$ microorganisms total may be administered to the subject in a given dosage form. In one mode, an effective amount may be provided in from 1 to 500 ml or from 1 to 500 grams of the bacterial composition having from $10^8$ to $10^{11}$ bacteria per ml or per gram, or a capsule, tablet or suppository having from 1 mg to 1000 mg lyophilized powder having from $10^8$ to $10^{15}$ bacteria. Those receiving acute treatment may receive higher doses than those who are receiving chronic administration (such as hospital workers or those admitted into long-term care facilities).

Any of the preparations described herein may be administered once on a single occasion or on multiple occasions, such as once a day for several days or more than once a day on the day of administration (including twice daily, three times daily, or up to five times daily). Or the preparation may be administered intermittently according to a set schedule, e.g., once a day, once weekly, or once monthly, or when the subject relapses from the primary illness. In another embodiment, the preparation may be administered on a long-term basis to individuals who are at risk for infection with or who may be carriers of these pathogens, including individuals who will have an invasive medical procedure (such as surgery), who will be hospitalized, who live in a long-term care or rehabilitation facility, who are exposed to pathogens by virtue of their profession (livestock and animal processing workers), or who could be carriers of pathogens (including hospital workers such as physicians, nurses, and other health care professionals).

E. Subject Selection

Particular bacterial compositions may be selected for individual subjects or for subjects with particular profiles. For example, 16S sequencing may be performed for a given subject to identify the bacteria present in his or her microbiota. The sequencing may either profile the subject's entire microbiome using 16S sequencing (to the family, genera, or species level), a portion of the subject's microbiome using 16S sequencing, or it may be used to detect the presence or absence of specific candidate bacteria that are biomarkers for health or a particular disease state. Based on the biomarker data, a particular composition may be selected for administration to a subject to supplement or complement a subject's microbiota in order to restore health or treat or prevent disease.

The specification is most thoroughly understood in light of the teachings of the references cited within the specification. The embodiments within the specification provide an illustration of embodiments and should not be construed to limit the scope. The skilled artisan readily recognizes that many other embodiments are encompassed. All publications and patents cited in this disclosure are incorporated by reference in their entirety. To the extent the material incorporated by reference contradicts or is inconsistent with this specification, the specification will supersede any such material. The citation of any references herein is not an admission that such references are prior art.

Unless otherwise indicated, all numbers expressing quantities of ingredients, reaction conditions, and so forth used in the specification, including claims, are to be understood as being modified in all instances by the term "about." Accordingly, unless otherwise indicated to the contrary, the numerical parameters are approximations and may vary depending upon the desired properties sought to be obtained. At the very least, and not as an attempt to limit the application of the doctrine of equivalents to the scope of the claims, each numerical parameter should be construed in light of the number of significant digits and ordinary rounding approaches.

Unless otherwise indicated, the term "at least" preceding a series of elements is to be understood to refer to every element in the series.

EXAMPLES

Below are examples of specific embodiments for carrying out the present invention. The examples are offered for illustrative purposes only, and are not intended to limit the scope of the present invention in any way. Efforts have been made to ensure accuracy with respect to numbers used (e.g., amounts, temperatures, etc.), but some experimental error and deviation should, of course, be allowed for.

The practice of the present invention will employ, unless otherwise indicated, conventional methods of protein chemistry, biochemistry, recombinant DNA techniques and pharmacology, within the skill of the art. Such techniques are explained fully in the literature. See, e.g., T. E. Creighton, *Proteins: Structures and Molecular Properties* (W.H. Freeman and Company, 1993); A. L. Lehninger, *Biochemistry* (Worth Publishers, Inc., current addition); Sambrook, et al., *Molecular Cloning: A Laboratory Manual* (2nd Edition, 1989); *Methods In Enzymology* (S. Colowick and N. Kaplan eds., Academic Press, Inc.); *Remington's Pharmaceutical Sciences*, 18th Edition (Easton, Pa.: Mack Publishing Company, 1990); Carey and Sundberg *Advanced Organic Chemistry* $3^{rd}$ Ed. (Plenum Press) Vols A and B(1992).

Example 1

Administration of Bacterial Compositions to Mammalian Subjects Having *C. difficile* Infection An in vivo mouse model was employed to demonstrate the protective effect of the bacterial compositions against *C. difficile*. In this model (based on Chen, et al., A mouse model of *Clostridium difficile* associated disease, Gastroenterology 135(6):1984-1992 (2008)), mice were made susceptible to *C. difficile* by a 7 or 9 day treatment (days –14 or –12 until –5 of experiment) with 5 to 7 antibiotics (kanamycin, colistin, gentamycin, metronidazole and vancomycin, and optionally including ampicillin and ciprofloxacin) delivered via their drinking water, followed by a single dose with clindamycin on day –3. The mice were then challenged three days later (on day 0) with $10^4$ spores of *C. difficile* via oral gavage (i.e., oro-gastric lavage). The outcomes assessed each day from day 0 to day 6 were weight, clinical signs, mortality and shedding of *C. difficile* in the feces. Weight, clinical signs and mortality were also evaluated on day –1. Weight loss, clinical signs of disease, and *C. difficile* shedding were typically observed without treatment. Vancomycin treatment protects against these outcomes and serves as a positive control when provided by oral gavage on days –1 to 4. Clinical signs were subjective, and scored each day by the same experienced observer. Mortality includes euthanasia of animals that lose greater than or equal to 25% of their body weight or that display severe morbidity as assessed by clinical signs. Feces were gathered from the mouse cages (5 mice per cage) each day, and suspended in 5 mL of PBS by vortexing. The shedding of *C. difficile* spores is detected in the feces using a selective plating assay as described for the in vitro assay above, after a 1 hour treatment with 50% ethanol at room temperature to kill *C. difficile* vegetative cells. *C. difficile* may also be detected in the mouse fecal suspension via qPCR for the toxin gene as described herein. The effects of various administrations, including 10% suspension of human feces in PBS (as a positive control), microbial compositions, or PBS (as a negative vehicle control), were determined by introducing the bacterial composition in a 0.2 mL volume into the mice via oral gavage on day –1, one day prior to *C. difficile* challenge. Vancomycin, as discussed above, is given on days –1 to –4 as another positive control. Alternative dosing schedules can be employed, including multiple doses of bacterial composition, and $10^3$ to $10^{10}$ of a given organism or composition may be delivered.

Exemplary bacterial compositions as described herein were administered as follows.

In a first demonstration, the results of which are provided in tabular form as Table 3B, Treatment 1 is the vehicle control of phosphate buffered saline (PBS), Treatment 2 is a positive control of 10% fecal suspension in PBS which has total anaerobic cfu/ml of $4.5 \times 10^9$, Treatment 3 is a positive control of 10% fecal suspension in PBS which has total anaerobic cfu/ml of $6.2 \times 10^8$, Treatment 4 is a bacterial composition comprising *Escherichia coli* (family *Enterobacteriaceae*, ATCC 35320), *Enterococcus faecalis* (family *Enterococcaceae* ATCC, 19433), *Blautia producta* (family *Lachnospiraceae*, DSM 14466), *Bacteroides vulgatus* (family *Bacteroidaceae*, ATCC 8482), *Bacteroides thetaiotaomicron* (family *Bacteroidaceae*, ATCC 29148), *Bacteroides ovatus* (family *Bacteroidaceae*, ATCC 8483), *Clostridium bifermentans* (family *Peptostreptococcaceae*, ATCC 638), *Clostridium ramosum* (family *Erysipelotrichaceae*, ATCC 25582), *Clostridium innocuum* (family *Erysipelotrichaceae*, DSM 22910) with a total anaerobic cfu/ml of $7.1 \times 10^9$. Treatment 5 is a bacterial composition comprising *Escherichia coli* (family *Enterobacteriaceae*, ATCC 35320), *Enterococcus faecalis* (family *Enterococcaceae* ATCC, 19433), *Blautia producta* (family *Lachnospiraceae*, DSM 14466), *Bacteroides vulgatus* (family *Bacteroidaceae*, ATCC 8482), *Bacteroides thetaiotaomicron* (family *Bacteroidaceae*, ATCC 29148), *Bacteroides ovatus* (family *Bacteroidaceae*, ATCC 8483), *Clostridium bifermentans* (family *Peptostreptococcaceae*, ATCC 638), *Clostridium ramosum* (family *Erysipelotrichaceae*, ATCC 25582), *Clostridium innocuum* (family *Erysipelotrichaceae*, DSM 22910) with a total anaerobic cfu/ml of $7.1 \times 10^8$. Treatment 6 is a bacterial composition comprising *Escherichia coli* (family *Enterobacteriaceae*, ATCC 35320), *Enterococcus faecalis* (family *EnterococcaceaeATCC*, 19433), *Blautia producta* (family *Lachnospiraceae*, DSM 14466), *Bacteroides vulgatus* (family *Bacteroidaceae*, ATCC 8482), *Bacteroides thetaiotaomicron* (family *Bacteroidaceae*, ATCC 29148), *Bacteroides ovatus* (family *Bacteroidaceae*, ATCC 8483), *Clostridium bifermentans* (family *Peptostreptococcaceae*, ATCC 638), *Clostridium ramosum* (family *Erysipelotrichaceae*, ATCC 25582), *Clostridium innocuum* (family *Erysipelotrichaceae*, DSM 22910) with a total anaerobic cfu/ml of $7.1 \times 10^7$. Treatment 7 is a bacterial composition comprising *Escherichia coli* (family *Enterobacteriaceae*, ATCC 35320), *Enterococcus faecalis* (family *Enterococcaceae* ATCC, 19433), *Blautia producta* (family *Lachnospiraceae*, DSM 14466), *Clostridium bifermentans* (family *Peptostreptococcaceae*, ATCC 638), *Clostridium ramosum* (family *Erysipelotrichaceae*, ATCC 25582), *Clostridium innocuum* (family *Erysipelotrichaceae*, DSM 22910) with a total anaerobic cfu/ml of $3.7 \times 10^9$. Treatment 8 is a bacterial composition comprising *Bacteroides* vulgatus (family *Bacteroidaceae*, ATCC 8482), *Bacteroides* thetaiotaomicron (family *Bacteroidaceae*, ATCC 29148), *Bacteroides ovatus* (family *Bacte-* roidaceae, ATCC 8483) with a total anaerobic cfu/ml of $3.5 \times 10^9$. Treatment 9 is a bacterial composition comprising *Enterococcus faecalis* (family *Enterococcaceae* ATCC, 19433), *Bacteroides vulgatus* (family *Bacteroidaceae*, ATCC 8482), *Bacteroides thetaiotaomicron* (family *Bacteroidaceae*, ATCC 29148), *Bacteroides ovatus* (family *Bacteroidaceae*, ATCC 8483), *Clostridium ramosum* (family *Erysipelotrichaceae*, ATCC 25582), *Clostridium innocuum* (family *Erysipelotrichaceae*, DSM 22910) with a total anaerobic cfu/ml of $6.7 \times 10^9$. Treatment 10 is a bacterial composition comprising *Clostridium bifermentans* (family *Peptostreptococcaceae*, ATCC 638), *Clostridium ramosum* (family *Erysipelotrichaceae*, ATCC 25582), and *Clostridium innocuum* (family *Erysipelotrichaceae*, DSM 22910) with a total anaerobic cfu/ml of $1.2 \times 10^9$. Treatment 11 is a bacterial composition comprising *Escherichia coli* (family *Enterobacteriaceae*, ATCC 35320), *Enterococcus faecalis* (family *Enterococcaceae* ATCC, 19433), *Blautia producta* (family *Lachnospiraceae*, DSM 14466), *Bacteroides* vulgatus (family *Bacteroidaceae*, ATCC 8482), *Bacteroides thetaiotaomicron* (family *Bacteroidaceae*, ATCC 29148), *Bacteroides ovatus* (family *Bacteroidaceae*, ATCC 8483), *Clostridium celatum* (family *Clostridiaceae*, SPC21278) with a total anaerobic cfu/ml of $6.1 \times 10^9$. Treatment 12 is a bacterial composition comprising *Escherichia coli* (family *Enterobacteriaceae*, ATCC 35320), *Enterococcus faecalis* (family *Enterococcaceae* ATCC, 19433), *Bacteroides vulgatus* (family *Bacteroidaceae*, ATCC 8482), *Bacteroides thetaiotaomicron* (family *Bacteroidaceae*, ATCC 29148), *Bacteroides ovatus* (family *Bacteroidaceae*, ATCC 8483), *Clostridium bifermentans* (family *Peptostreptococcaceae*, ATCC 638), *Clostridium ramosum* (family *Erysipelotrichaceae*, ATCC 25582), *Clostridium innocuum* (family *Erysipelotrichaceae*, DSM 22910) with a total anaerobic cfu/ml of $1 \times 10^{10}$.

In a second demonstration, the results of which are provided in tabular form as Table 2, Treatment 1 is the vehicle control of phosphate buffered saline (PBS), Treatment 2 is a positive control of 10% fecal suspension in PBS which has total anaerobic cfu/ml of $5 \times 10^9$, Treatment 3 is a positive control of 10% fecal suspension in PBS which has total anaerobic cfu/ml of $7 \times 10^8$.

Treatment 4 is a bacterial composition comprising *Escherichia coli* (family *Enterobacteriaceae*, ATCC 35320), *Enterococcus faecalis* (family *Enterococcaceae* ATCC, 19433), *Blautia producta* (family *Lachnospiraceae*, DSM 14466), *Bacteroides vulgatus* (family *Bacteroidaceae*, ATCC 8482), *Bacteroides thetaiotaomicron* (family *Bacteroidaceae*, ATCC 29148), *Bacteroides ovatus* (family *Bacteroidaceae*, ATCC 8483), *Clostridium bifermentans* (family *Peptostreptococcaceae*, ATCC 638), *Clostridium ramosum* (family *Erysipelotrichaceae*, ATCC 25582), *Clostridium innocuum* (family *Erysipelotrichaceae*, DSM 22910) with a total anaerobic cfu/ml of $2.2 \times 10^9$, Treatment 5 is a bacterial composition comprising *Escherichia coli* (family *Enterobacteriaceae*, ATCC 35320), *Enterococcus faecalis* (family *Enterococcaceae* ATCC, 19433), *Blautia producta* (family *Lachnospiraceae*, DSM 14466), *Bacteroides vulgatus* (family *Bacteroidaceae*, ATCC 8482), *Bacteroides thetaiotaomicron* (family *Bacteroidaceae*, ATCC 29148), *Bacteroides ovatus* (family *Bacteroidaceae*, ATCC 8483), *Clostridium bifermentans* (family *Peptostreptococcaceae*, ATCC 638), *Clostridium ramosum* (family *Erysipelotrichaceae*, ATCC 25582), *Clostridium innocuum* (family *Erysipelotrichaceae*, DSM 22910) with a total anaerobic cfu/ml of $2.2 \times 10^8$. Treatment 6 is a bacterial composition comprising *Escherichia coli* (family *Enterobacteriaceae*, ATCC 35320), *Enterococcus faecalis* (family *Enterococcaceae* ATCC, 19433), *Blautia producta* (family *Lachnospiraceae*, DSM 14466), *Bacteroides vulgatus* (family *Bacteroidaceae*, ATCC 8482), *Bacteroides thetaiotaomicron* (family *Bacteroidaceae*, ATCC 29148), *Bacteroides ovatus* (family *Bacteroidaceae*, ATCC 8483), *Clostridium bifermentans* (family *Peptostreptococcaceae*, ATCC 638), *Clostridium ramosum* (family *Erysipelotrichaceae*, ATCC 25582), *Clostridium innocuum* (family *Erysipelotrichaceae*, DSM 22910) with a total anaerobic cfu/ml of $2.2 \times 10^7$, Treatment 7 is a bacterial composition comprising *Escherichia coli* (family *Enterobacteriaceae*, ATCC 35320), *Enterococcus faecalis* (family *Enterococcaceae* ATCC, 19433), *Blautia producta* (family *Lachnospiraceae*, DSM 14466), *Bacteroides vulgatus* (family *Bacteroidaceae*, ATCC 8482), *Bacteroides thetaiotaomicron* (family *Bacteroidaceae*, ATCC 29148), *Bacteroides ovatus* (family *Bacteroidaceae*, ATCC 8483), *Clostridium innocuum* (family *Erysipelotrichaceae*, DSM 22910) with a total anaerobic cfu/ml of $5 \times 10^9$, Treatment 8 is a bacterial composition comprising *Escherichia coli* (family, *Enterobacteriaceae*, SPC21221), *Escherichia coli* (family, *Enterobacteriaceae*, SPC21248), *Enterococcus faecalis* (family, *Enterococcaceae*, SPC21240), *Enterococcus faecalis* (family, *Enterococcaceae*, SPC21252), *Blautia producta* (family, *Lachnospiraceae*, SPC2115104), *Bacteroides vulgatus* (family, *Bacteroidaceae*, SPC21122), *Bacteroides vulgatus* (family, *Bacteroidaceae*, SPC21192), *Bacteroides thetaiotaomicron* (family *Bacteroidaceae*, SPC21132), *Bacteroides thetaiotaomicron*, (family *Bacteroidaceae*, SPC21133), *Bacteroides ovatus* (family, Bacteroidaceae, SPC21141), *Bacteroides ovatus* (family, Bacteroidaceae, SPC21181), *Clostridium innocuum* (family, *Erysipelotrichaceae*, SPC21112), *Clostridium bifermentans* (family *Peptostreptococcaceae*, ATCC 638), *Clostridium ramosum* (family *Erysipelotrichaceae*, ATCC 25582), with a total anaerobic cfu/ml of $1.7 \times 10^{10}$, Treatment 9 is a bacterial composition comprising *Escherichia coli* (family, *Enterobacteriaceae*, SPC21221), *Escherichia coli* (family, *Enterobacteriaceae*, SPC21248), *Enterococcus faecalis* (family, *Enterococcaceae*, SPC21240), *Enterococcus faecalis* (family, *Enterococcaceae*, SPC21252), *Blautia producta* (family, *Lachnospiraceae*, SPC2115104), *Bacteroides vulgatus* (family, Bacteroidaceae, SPC21122), *Bacteroides vulgatus* (family, Bacteroidaceae, SPC21192), *Bacteroides thetaiotaomicron* (family Bacteroidaceae, SPC21132), *Bacteroides thetaiotaomicron*, (family Bacteroidaceae, SPC21133), *Bacteroides ovatus* (family, Bacteroidaceae, SPC21141), *Bacteroides ovatus* (family, Bacteroidaceae, SPC21181), *Clostridium innocuum* (family, *Erysipelotrichaceae*, SPC21112), *Clostridium bifermentans* (family *Peptostreptococcaceae*, ATCC 638), *Clostridium ramosum* (family *Erysipelotrichaceae*, ATCC 25582), with a total anaerobic cfu/ml of $1.7 \times 10^9$, Treatment 10 is a bacterial composition comprising *Escherichia coli* (family, *Enterobacteriaceae*, SPC21221), *Escherichia coli* (family, *Enterobacteriaceae*, SPC21248), *Enterococcus faecalis* (family, *Enterococcaceae*, SPC21240), *Enterococcus faecalis* (family, *Enterococcaceae*, SPC21252), *Blautia producta* (family, *Lachnospiraceae*, SPC2115104), *Bacteroides vulgatus* (family, Bacteroidaceae, SPC21122), *Bacteroides vulgatus* (family, Bacteroidaceae, SPC21192), *Bacteroides thetaiotaomicron* (family Bacteroidaceae, SPC21132), *Bacteroides thetaiotaomicron*, (family Bacteroidaceae, SPC21133), *Bacteroides ovatus* (family, Bacteroidaceae, SPC21141), *Bacteroides ovatus* (family, Bacteroidaceae, SPC21181), *Clostridium innocuum* (family, *Erysipelotrichaceae*, SPC21112), *Clostridium bifermentans* (family Peptostreptococcaceae, ATCC 638), and *Clostridium ramosum* (family *Erysipelotrichaceae*, ATCC 25582), with a total anaerobic cfu/ml of $1.7\times10^8$, Treatment 11 is a bacterial composition comprising *Escherichia coli* (family, *Enterobacteriaceae*, SPC21221), *Escherichia coli* (family, *Enterobacteriaceae*, SPC21248), *Enterococcus faecalis* (family, *Enterococcaceae*, SPC21240), *Enterococcus faecalis* (family, *Enterococcaceae*, SPC21252), *Blautia producta* (family, *Lachnospiraceae*, SPC2115104), *Bacteroides vulgatus* (family, Bacteroidaceae, SPC21122), *Bacteroides vulgatus* (family, Bacteroidaceae, SPC21192), *Bacteroides thetaiotaomicron* (family Bacteroidaceae, SPC21132), *Bacteroides thetaiotaomicron*, (family Bacteroidaceae, SPC21133), *Bacteroides ovatus* (family, Bacteroidaceae, SPC21141), *Bacteroides ovatus* (family, Bacteroidaceae, SPC21181), and *Clostridium innocuum* (family, Erysipelotrichaceae, SPC21112) with a total anaerobic cfu/ml of $1.2\times10^{10}$, Treatment 12 is a bacterial composition comprising *Escherichia coli* (family, *Enterobacteriaceae*, SPC21221), *Escherichia coli* (family, *Enterobacteriaceae*, SPC21248), *Enterococcus faecalis* (family, *Enterococcaceae*, SPC21240), *Enterococcus faecalis* (family, *Enterococcaceae*, SPC21252), *Blautia producta* (family, *Lachnospiraceae*, SPC2115104), *Bacteroides vulgatus* (family, Bacteroidaceae, SPC21122), *Bacteroides vulgatus* (family, Bacteroidaceae, SPC21192), *Bacteroides thetaiotaomicron* (family Bacteroidaceae, SPC21132), *Bacteroides thetaiotaomicron*, (family Bacteroidaceae, SPC21133), *Bacteroides ovatus* (family, Bacteroidaceae, SPC21141), *Bacteroides ovatus* (family, Bacteroidaceae, SPC21181), *Clostridium innocuum* (family, *Erysipelotrichaceae*, SPC21112), and *Clostridium celatum* (family Clostridiaceae, SPC21278) with a total anaerobic cfu/ml of $9\times10^9$, Treatment 13 is a bacterial composition comprising *Escherichia coli* (family *Enterobacteriaceae*, SPC21221), *Enterococcus faecalis* (family *Enterococcaceae*, SPC21240), *Blautia producta* (family *Lachnospiraceae*, SPC2115104), *Bacteroides vulgatus* (family Bacteroidaceae, SPC21122), *Bacteroides thetaiotaomicron* (family Bacteroidaceae, SPC21132), *Bacteroides ovatus* (family Bacteroidaceae, SPC21141), and *Clostridium innocuum* (family *Erysipelotrichaceae*, SPC21112) with a total anaerobic cfu/ml of $6\times10^9$. Treatment 14 is a bacterial composition comprising *Escherichia coli* (family *Enterobacteriaceae*, SPC21248), *Enterococcus faecalis* (family *Enterococcaceae*, SPC21252), *Blautia producta* (family *Lachnospiraceae*, SPC2115104), *Bacteroides* vulgatus (family, Bacteroidaceae, SPC21192), *Bacteroides thetaiotaomicron* (family Bacteroidaceae, SPC21133), *Bacteroides ovatus* (family Bacteroidaceae, SPC21181), and *Clostridium innocuum* (family *Erysipelotrichaceae*, SPC21112) with a total anaerobic cfu/ml of $5\times10^9$.

In a third demonstration, the results of which are provided in tabular form as Table 3A, Treatment 1 is the vehicle control of phosphate buffered saline (PBS), Treatment 2 is a positive control of 10% fecal suspension in PBS which has total anaerobic cfu/ml of $2.3\times10^{11}$, Treatment 3 is a bacterial composition comprising *Escherichia coli* (family *Enterobacteriaceae*, SPC21221), *Enterococcus faecalis* (family *Enterococcaceae*, SPC21240), *Blautia producta* (family *Lachnospiraceae*, SPC2115104), *Bacteroides vulgatus* (family *Bacteroidaceae*, SPC21192), *Bacteroides thetaiotaomicron* (family *Bacteroidaceae*, SPC21132), *Bacteroides Bacteroides ovatus* (family Bacteroidaceae, SPC21141), *Clostridium innocuum* (family *Erysipelotrichaceae*, SPC21112), and *Clostridium celatum* (family *Clostridiaceae*, SPC21278) with a total anaerobic cfu/ml of $2.5\times10^9$, Treatment 4 is a bacterial composition comprising *Escherichia coli* (family *Enterobacteriaceae*, SPC21221), *Enterococcus faecalis* (family *Enterococcaceae*, SPC21240), *Blautia producta* (family *Lachnospiraceae*, SPC2115104), *Bacteroides vulgatus* (family *Bacteroidaceae*, SPC21192), *Bacteroides thetaiotaomicron* (family *Bacteroidaceae*, SPC21132), *Bacteroides ovatus* (family *Bacteroidaceae*, SPC21141), *Clostridium innocuum* (family *Erysipelotrichaceae*, SPC21112), and *Clostridium celatum* (family Clostridiaceae, SPC21278) with a total anaerobic cfu/ml of $2.5\times10^8$, Treatment 5 is a bacterial composition comprising *Escherichia coli* (family *Enterobacteriaceae*, SPC21221), *Enterococcus faecalis* (family *Enterococcaceae*, SPC21240), *Blautia producta* (family *Lachnospiraceae*, SPC2115104), *Bacteroides vulgatus* (family *Bacteroidaceae*, SPC21192), *Bacteroides thetaiotaomicron* (family *Bacteroidaceae*, SPC21132), *Bacteroides ovatus* (family *Bacteroidaceae*, SPC21141), *Clostridium innocuum* (family *Erysipelotrichaceae*, SPC21112), and *Clostridium celatum* (family Clostridiaceae, SPC21278) with a total anaerobic cfu/ml of $2.5\times10^7$, Treatment 6 is a bacterial composition comprising Blautia *producta* (family *Lachnospiraceae*, SPC2115104), *Bacteroides vulgatus* (family *Bacteroidaceae*, SPC21192), *Bacteroides thetaiotaomicron* (family *Bacteroidaceae*, SPC21132), *Bacteroides ovatus* (family *Bacteroidaceae*, SPC21141), *Clostridium innocuum* (family *Erysipelotrichaceae*, SPC21112), and *Clostridium celatum* (family *Clostridiaceae*, SPC21278) with a total anaerobic cfu/ml of $2.8\times10^9$, Treatment 7 is a bacterial composition comprising *Escherichia coli* (family *Enterobacteriaceae*, SPC21221), *Enterococcus faecalis* (family *Enterococcaceae*, SPC21240), *Bacteroides vulgatus* (family *Bacteroidaceae*, SPC21192), *Bacteroides thetaiotaomicron* (family *Bacteroidaceae*, SPC21132), *Bacteroides ovatus* (family *Bacteroidaceae*, SPC21141), *Clostridium innocuum* (family *Erysipelotrichaceae*, SPC21112), and *Clostridium celatum* (family *Clostridiaceae*, SPC21278) with a total anaerobic cfu/ml of $6\times10^9$, Treatment 8 is a bacterial composition comprising *Escherichia coli* (family *Enterobacteriaceae*, SPC21221), *Enterococcus faecalis* (family *Enterococcaceae*, SPC21240), *Blautia producta* (family *Lachnospiraceae*, SPC2115104), *Clostridium innocuum* (family *Erysipelotrichaceae*, SPC21112), and *Clostridium celatum* (family *Clostridiaceae*, SPC21278) with a total anaerobic cfu/ml of $1.8\times10^9$, Treatment 9 is a bacterial composition comprising *Escherichia coli* (family *Enterobacteriaceae*, SPC21221), *Enterococcus faecalis* (family *Enterococcaceae*, SPC21240), *Blautia producta* (family *Lachnospiraceae*, SPC2115104), *Bacteroides vulgatus* (family *Bacteroidaceae*, SPC21192), *Bacteroides thetaiotaomicron* (family *Bacteroidaceae*, SPC21132), and *Bacteroides ovatus* (family *Bacteroidaceae*, SPC21141) with a total anaerobic cfu/ml of $2\times10^9$, Treatment 10 is a bacterial composition comprising *Escherichia coli* (family *Enterobacteriaceae*, SPC21221), *Enterococcus faecalis* (family *Enterococcaceae*, SPC21240), Blautia *producta* (family *Lachnospiraceae*, SPC2115104), *Bacteroides* vulgatus (family *Bacteroidaceae*, SPC21192), *Bacteroides thetaiotaomicron* (family *Bacteroidaceae*, SPC21132), *Bacteroides ovatus* (family *Bacteroidaceae*, SPC21141), *Clostridium innocuum* (family *Erysipelotrichaceae*, SPC21112),

*Clostridium celatum* (family *Clostridiaceae*, SPC21278), *Clostridium butyricum* (family *Clostridiaceae*, SPC21367), and *Clostridium glycolicum* (family Peptostreptococcaceae, SPC21349) with a total anaerobic cfu/ml of $8\times10^9$, Treatment 11 is a bacterial composition comprising *Escherichia* coli (family *Enterobacteriaceae*, SPC21221), *Enterococcus faecalis* (family *Enterococcaceae*, SPC21240), *Blautia producta* (family *Lachnospiraceae*, SPC2115104), *Bacteroides vulgatus* (family *Bacteroidaceae*, SPC21192), *Bacteroides thetaiotaomicron* (family *Bacteroidaceae*, SPC21132), *Bacteroides Bacteroides ovatus* (family *Bacteroidaceae*, SPC21141), *Clostridium innocuum* (family *Erysipelotrichaceae*, SPC21112), *Clostridium celatum* (family *Clostridiaceae*, SPC21278), *Clostridium* butyricum (family *Clostridiaceae*, SPC21367), *Clostridium glycolicum* (family *Peptostreptococcaceae*, SPC21349), *Dorea formicigerans* (family *Lachnospiraceae*, SPC21308), *Ruminococcus torques* (family *Ruminococcaceae*, SPC21344), *Eubacterium tenue* (family *Peptostreptococcaceae*, SPC21391) and *Eubacterium cylindroides* (family *Erysipelotrichacea*, SPC21300) with a total anaerobic cfu/ml of $2.5\times10^9$. Treatment 12 is a bacterial composition comprising *Blautia producta* (family *Lachnospiraceae*, SPC2115104), *Clostridium innocuum* (family *Erysipelotrichaceae*, SPC21112), and *Clostridium celatum* (family *Clostridiaceae*, SPC21278), with a total anaerobic cfu/ml of $2.1\times10^7$. Treatment 13 is a bacterial composition comprising *Blautia producta* (family *Lachnospiraceae*, SPC2115104), *Clostridium innocuum* (family *Erysipelotrichaceae*, SPC21112), *Clostridium celatum* (family *Clostridiaceae*, SPC21278), *Clostridium butyricum* (family *Clostridiaceae*, SPC21367), and *Clostridium glycolicum* (family Peptostreptococcaceae, SPC21349) with a total anaerobic cfu/ml of $1.4\times10^8$. Treatment 14 is a bacterial composition comprising Blautia *producta* (family *Lachnospiraceae*, SPC2115104), *Clostridium innocuum* (family *Erysipelotrichaceae*, SPC21112), *Clostridium celatum* (family *Clostridiaceae*, SPC21278), *Clostridium butyricum* (family *Clostridiaceae*, SPC21367), *Clostridium glycolicum* (family *Peptostreptococcaceae*, SPC21349), *Dorea formicigerans* (family *Lachnospiraceae*, SPC21308), *Ruminococcus torques* (family *Ruminococcaceae*, SPC21344), *Eubacterium tenue* (family *Peptostreptococcaceae*, SPC21391) and *Eubacterium cylindroides* (family *Erysipelotrichacea*, SPC21300) with a total anaerobic cfu/ml of $3.1\times10^7$. Treatment 15 is a bacterial composition comprising *Escherichia coli* (family *Enterobacteriaceae*, SPC21221), *Enterococcus faecalis* (family *Enterococcaceae*, SPC21240), Blautia *producta* (family *Lachnospiraceae*, SPC2115104), *Bacteroides vulgatus* (family *Bacteroidaceae*, SPC21192), *Bacteroides thetaiotaomicron* (family *Bacteroidaceae*, SPC21132), *Bacteroides ovatus* (family *Bacteroidaceae*, SPC21141), *Clostridium innocuum* (family *Erysipelotrichaceae*, SPC21112), *Clostridium celatum* (family *Clostridiaceae*, SPC21278), *Clostridium butyricum* (family *Clostridiaceae*, SPC21367), *Clostridium glycolicum* (family *Peptostreptococcaceae*, SPC21349), *Dorea formicigerans* (family *Lachnospiraceae*, SPC21308), *Ruminococcus torques* (family *Ruminococcaceae*, SPC21344), *Eubacterium tenue* (family *Peptostreptococcaceae*, SPC21391) and *Eubacterium cylindroides* (family *Erysipelotrichacea*, SPC21300) that was treated with 50% EtOH for 1 hour at 37C, centrifuged to pellet the bacterial cells and resuspended in sterile PBS at the equivalent original volume and having a total anaerobic cfu/ml of $1.3\times10^7$.

For each of the three demonstrations, scores for each treatment range from 0 to 9. Scores were calculated as follows. Groups of animals (N=10/group) were scored for % mortality. Mortality was normalized in a given demonstration by setting the observed mortality of the PBS vehicle control group=3. A treatment group was then scored based on the observed mortality for that group divided by the mortality of the PBS vehicle control times 3. Thus, if the mortality of the PBS vehicle group was 60% (score=3), then a treatment group with mortality of 30% would receive a score of 1.5. Similarly, mean weight loss on Day 3 was normalized to a score of 3 for the PBS vehicle control group. A score for each treatment was calculated by dividing the actual mean weight loss by the mean weight loss for the PBS vehicle control group and multiplying by 3. A similar procedure was used for the clinical scores evaluation. Finally, the individual values for mortality, mean weight loss on Day 3 and clinical scores were summed to give a final value of 0-9 for each treatment, with 0 being best (no death, no weight loss, no clinical symptoms) and 9 being equivalent to the vehicle control.

Example 2

Species Identification

The identity of the bacterial species which grew up from a complex fraction can be determined in multiple ways. First, individual colonies can be picked into liquid media in a 96 well format, grown up and saved as 15% glycerol stocks at −80 C Aliquots of the cultures can be placed into cell lysis buffer and colony PCR methods can be used to amplify and sequence the 16S rDNA gene (described below in Example 3). Alternatively, colonies may be streaked to purity in several passages on solid media. Well separated colonies are streaked onto the fresh plates of the same kind and incubated for 48-72 hours at 37 C The process is repeated multiple times in order to ensure purity. Pure cultures can be analyzed by phenotypic- or sequence-based methods, including 16S rDNA amplification and sequencing as described in Examples 3 and 4. Sequence characterization of pure isolates or mixed communities e.g. plate scrapes and spore fractions can also include whole genome shotgun sequencing. The latter is valuable to determine the presence of genes associated with sporulation, antibiotic resistance, pathogenicity, and virulence. Colonies can also be scraped from plates en masse and sequenced using a massively parallel sequencing method as described in Examples 3 & 4 such that individual 16S signatures can be identified in a complex mixture. Optionally, the sample can be sequenced prior to germination (if appropriate DNA isolation procedures are used to lsye and release the DNA from spores) in order to compare the diversity of germinable species with the total number of species in a spore sample. As an alternative or complementary approach to 16S analysis, MALDI-TOF-mass spec can also be used for species identification (as reviewed in Anaerobe 22:123).

Example 3

16s Sequencing to Determine Operational Taxonomic Unit (OTU)

Method for Determining 16S Sequence
OTUs may be defined either by full 16S sequencing of the rRNA gene, by sequencing of a specific hypervariable region of this gene (i.e. V1, V2, V3, V4, V5, V6, V7, V8, or V9), or by sequencing of any combination of hypervariable regions from this gene (e.g. V1-3 or V3-5). The bacterial 16S rDNA is approximately 1500 nucleotides in length and is used in reconstructing the evolutionary relationships and sequence similarity of one bacterial isolate to another using phylogenetic approaches. 16S sequences are used for phylogenetic reconstruction as they are in general highly conserved, but contain specific hypervariable regions that harbor sufficient nucleotide diversity to differentiate genera and species of most microbes.

Using well known techniques, in order to determine the full 16S sequence or the sequence of any hypervariable region of the 16S sequence, genomic DNA is extracted from a bacterial sample, the 16S rDNA (full region or specific hypervariable regions) amplified using polymerase chain reaction (PCR), the PCR products cleaned, and nucleotide sequences delineated to determine the genetic composition of 16S gene or subdomain of the gene. If full 16S sequencing is performed, the sequencing method used may be, but is not limited to, Sanger sequencing. If one or more hypervariable regions are used, such as the V4 region, the sequencing may be, but is not limited to being, performed using the Sanger method or using a next-generation sequencing method, such as an Illumina (sequencing by synthesis) method using barcoded primers allowing for multiplex reactions.

In addition to the 16S rRNA gene, one may define an OTU by sequencing a selected set of genes that are known to be marker genes for a given species or taxonomic group of OTUs. These genes may alternatively be assayed using a PCR-based screening strategy. As example, various strains of pathogenic *Escherichia coli* can be distinguished using DNAs from the genes that encode heat-labile (LTI, LTIIa, and LTIIb) and heat-stable (STI and STII) toxins, verotoxin types 1, 2, and 2e (VT1, VT2, and VT2e, respectively), cytotoxic necrotizing factors (CNF1 and CNF2), attaching and effacing mechanisms (eaeA), enteroaggregative mechanisms (Eagg), and enteroinvasive mechanisms (Einv). The optimal genes to utilize for taxonomic assignment of OTUs by use of marker genes will be familiar to one with ordinary skill of the art of sequence based taxonomic identification and may include, but will not be limited, to highly conserved "house-keeping" genes or a combination thereof, full-genome sequence, or partial genome sequence generated using amplified genetic products, or whole genome sequence (WGS). Using well defined methods DNA extracted from a bacterial sample will have specific genomic regions amplified using PCR and sequenced to determine the nucleotide sequence of the amplified products. In the whole genome shotgun (WGS) method, extracted DNA will be directly sequenced without amplification. Sequence data can be generated using any sequencing technology including, but not limited to Sanger, Illumina, 454 Life Sciences, Ion Torrent, ABI, Pacific Biosciences, and/or Oxford Nanopore.

Genomic DNA Extraction

Genomic DNA is extracted from pure microbial cultures using a hot alkaline lysis method. 1 µl of microbial culture is added to 9 µl of Lysis Buffer (25 mM NaOH, 0.2 mM EDTA) and the mixture is incubated at 95° C. for 30 minutes. Subsequently, the samples are cooled to 4° C. and neutralized by the addition of 10 µl of Neutralization Buffer (40 mM Tris-HCl) and then diluted 10-fold in Elution Buffer (10 mM Tris-HCl). Alternatively, genomic DNA is extracted from pure microbial cultures using commercially available kits such as the Mo Bio Ultraclean® Microbial DNA Isolation Kit (Mo Bio Laboratories, Carlsbad, Calif.) or by standard methods known to those skilled in the art.

Amplification of 16S Sequences for Downstream Sanger Sequencing

To amplify bacterial 16S rDNA (FIG. 1A), 2 µl of extracted gDNA is added to a 20 µl final volume PCR reaction. For full-length 16 sequencing the PCR reaction also contains 1x HotMasterMix (5PRIME, Gaithersburg, Md.), 250 nM of 27f (AGRGTTTGATCMTGGCTCAG (SEQ ID NO: 2033), IDT, Coralville, Iowa), and 250 nM of 1492r (TACGGYTACCTTGTTAYGACTT (SEQ ID NO: 2034), IDT, Coralville, Iowa), with PCR Water (Mo Bio Laboratories, Carlsbad, Calif.) for the balance of the volume. Alternatively, other universal bacterial primers or thermostable polymerases known to those skilled in the art are used. For example primers are available to those skilled in the art for the sequencing of the "V1-V9 regions" of the 16S rRNA (FIG. 1A). These regions refer to the first through ninth hypervariable regions of the 16S rRNA gene that are used for genetic typing of bacterial samples. These regions in bacteria are defined by nucleotides 69-99, 137-242, 433-497, 576-682, 822-879, 986-1043, 1117-1173, 1243-1294 and 1435-1465 respectively using numbering based on the *E. coli* system of nomenclature. Brosius et al., Complete nucleotide sequence of a 16S ribosomal RNA gene from *Escherichia coli*, PNAS 75(10):4801-4805 (1978). In some embodiments, at least one of the V1, V2, V3, V4, V5, V6, V7, V8, and V9 regions are used to characterize an OTU. In one embodiment, the V1, V2, and V3 regions are used to characterize an OTU. In another embodiment, the V3, V4, and V5 regions are used to characterize an OTU. In another embodiment, the V4 region is used to characterize an OTU. A person of ordinary skill in the art can identify the specific hypervariable regions of a candidate 16S rRNA (in FIG. 1A) by comparing the candidate sequence in question to the reference sequence (FIG. 1B) and identifying the hypervariable regions based on similarity to the reference hypervariable regions.

The PCR is performed on commercially available thermocyclers such as a BioRad MyCycler™ Thermal Cycler (BioRad, Hercules, Calif.). The reactions are run at 94° C. for 2 minutes followed by 30 cycles of 94° C. for 30 seconds, 51° C. for 30 seconds, and 68° C. for 1 minute 30 seconds, followed by a 7 minute extension at 72° C. and an indefinite hold at 4° C. Following PCR, gel electrophoresis of a portion of the reaction products is used to confirm successful amplification of a ~1.5 kb product.

To remove nucleotides and oligonucleotides from the PCR products, 2 µl of HT ExoSap-IT (Affymetrix, Santa Clara, Calif.) is added to 5 µl of PCR product followed by a 15 minute incubation at 37° C. and then a 15 minute inactivation at 80° C.

Amplification of 16S Sequences for Downstream Characterization by Massively Parallel Sequencing Technologies Amplification performed for downstream sequencing by short read technologies such as Illumina require amplification using primers known to those skilled in the art that additionally include a sequence-based barcoded tag. As example, to amplify the 16s hypervariable region V4 region of bacterial 16S rDNA, 2 µl of extracted gDNA is added to a 20 µl final volume PCR reaction. The PCR reaction also contains 1x HotMasterMix (5PRIME, Gaithersburg, Md.), 200 nM of V4 515f adapt (AATGATACGGCGAC-CACCGAGATCTACACTATGGTAAT-TGTGTGCCAGCMGCCGCG GTAA (SEQ ID NO: 2035), IDT, Coralville, Iowa), and 200 nM of barcoded 806rbc (CAAGCAGAAGACGGCATACGAGAT 12bpGolayBarcode AGTCAGTCAGCCGGACTAC HVGGGTWTCTAAT (SEQ ID NOS 2036 and 2037, respectively, in order of appearance), IDT, Coralville, Iowa), with PCR Water (Mo Bio Laboratories, Carlsbad, Calif.) for the balance of the volume. These primers incorporate barcoded adapters for Illumina sequencing by synthesis. Optionally, identical replicate, triplicate, or quadruplicate reactions may be performed. Alternatively other universal bacterial primers or thermostable polymerases known to those skilled in the art are used to obtain different amplification and sequencing error rates as well as results on alternative sequencing technologies.

The PCR amplification is performed on commercially available thermocyclers such as a BioRad MyCycler™ Thermal Cycler (BioRad, Hercules, Calif.). The reactions are run at 94° C. for 3 minutes followed by 25 cycles of 94° C. for 45 seconds, 50° C. for 1 minute, and 72° C. for 1 minute 30 seconds, followed by a 10 minute extension at 72° C. and a indefinite hold at 4° C. Following PCR, gel electrophoresis of a portion of the reaction products is used to confirm successful amplification of a ~1.5 kb product. PCR cleanup is performed as specified in the previous example.

Sanger Sequencing of Target Amplicons from Pure Homogeneous Samples

To detect nucleic acids for each sample, two sequencing reactions are performed to generate a forward and reverse sequencing read. For full-length 16s sequencing primers 27f and 1492r are used. 40 ng of ExoSap-IT-cleaned PCR products are mixed with 25 pmol of sequencing primer and Mo Bio Molecular Biology Grade Water (Mo Bio Laboratories, Carlsbad, Calif.) to 15 µl total volume. This reaction is submitted to a commercial sequencing organization such as Genewiz (South Plainfield, N.J.) for Sanger sequencing.

Massively Parallel Sequencing of Target Amplicons from Heterogeneous Samples

DNA Quantification & Library Construction.

The cleaned PCR amplification products are quantified using the Quant-iT™ PicoGreen® dsDNA Assay Kit (Life Technologies, Grand Island, N.Y.) according to the manufacturer's instructions. Following quantification, the barcoded cleaned PCR products are combined such that each distinct PCR product is at an equimolar ratio to create a prepared Illumina library.

Nucleic Acid Detection. The prepared library is sequenced on Illumina HiSeq or MiSeq sequencers (Illumina, San Diego, Calif.) with cluster generation, template hybridization, iso-thermal amplification, linearization, blocking and denaturization and hybridization of the sequencing primers performed according to the manufacturer's instructions. 16SV4SeqFw (TATGGTAAT-TGTGTGCCAGCMGCCGCGGTAA) (SEQ ID NO: 2038), 16SV4SeqRev (AGTCAGTCAGCCGGAC-TACHVGGGTWTCTAAT (SEQ ID NO: 2037)), and 16SV4Index (ATT-AGAWACCCBDGTAGTCCGGCTGACTGACT (SEQ ID NO: 2039)) (IDT, Coralville, Iowa) are used for sequencing. Other sequencing technologies can be used such as but not limited to 454, Pacific Biosciences, Helicos, Ion Torrent, and Nanopore using protocols that are standard to someone skilled in the art of genomic sequencing.

Example 4

Sequence Read Annotation

Primary Read Annotation

Nucleic acid sequences are analyzed and annotations are to define taxonomic assignments using sequence similarity and phylogenetic placement methods or a combination of the two strategies. A similar approach can be used to annotate protein names, transcription factor names, and any other classification schema for nucleic acid sequences. Sequence similarity based methods include those familiar to individuals skilled in the art including, but not limited to BLAST, BLASTx, tBLASTn, tBLASTx, RDP-classifier, DNAclust, and various implementations of these algorithms such as Qiime or Mothur. These methods rely on mapping a sequence read to a reference database and selecting the match with the best score and e-value. Common databases include, but are not limited to the Human Microbiome Project, NCBI non-redundant database, Greengenes, RDP, and Silva. Phylogenetic methods can be used in combination with sequence similarity methods to improve the calling accuracy of an annotation or taxonomic assignment. Here tree topologies and nodal structure are used to refine the resolution of the analysis. In this approach we analyze nucleic acid sequences using one of numerous sequence similarity approaches and leverage phylogenetic methods that are well known to those skilled in the art, including but not limited to maximum likelihood phylogenetic reconstruction (see e.g. Liu K, Linder C R, and Warnow T. 2011. RAxML and FastTree: Comparing Two Methods for Large-Scale Maximum Likelihood Phylogeny Estimation. PLoS ONE 6: e27731. McGuire G, Denham M C, and Balding D J. 2001. Models of sequence evolution for DNA sequences containing gaps. Mol. Biol. Evol 18: 481-490. Wróbel B. 2008. Statistical measures of uncertainty for branches in phylogenetic trees inferred from molecular sequences by using model-based methods. J. Appl. Genet. 49: 49-67.) Sequence reads are placed into a reference phylogeny comprised of appropriate reference sequences. Annotations are made based on the placement of the read in the phylogenetic tree. The certainty or significance of the OTU annotation is defined based on the OTU's sequence similarity to a reference nucleic acid sequence and the proximity of the OTU sequence relative to one or more reference sequences in the phylogeny. As an example, the specificity of a taxonomic assignment is defined with confidence at the the level of Family, Genus, Species, or Strain with the confidence determined based on the position of bootstrap supported branches in the reference phylogenetic tree relative to the placement of the OTU sequence being interrogated.

Clade Assignments

The ability of 16S-V4 OTU identification to assign an OTU as a specific species depends in part on the resolving power of the 16S-V4 region of the 16S gene for a particular species or group of species. Both the density of available reference 16S sequences for different regions of the tree as well as the inherent variability in the 16S gene between different species will determine the definitiveness of a taxonomic annotation. Given the topological nature of a phylogenetic tree and the fact that tree represents hierarchical relationships of OTUs to one another based on their sequence similarity and an underlying evolutionary model, taxonomic annotations of a read can be rolled up to a higher level using a clade-based assignment procedure (Table 1). Using this approach, clades are defined based on the topology of a phylogenetic tree that is constructed from full-length 16S sequences using maximum likelihood or other phylogenetic models familiar to individuals with ordinary skill in the art of phylogenetics. Clades are constructed to ensure that all OTUs in a given clade are: (i) within a specified number of bootstrap supported nodes from one another (generally, 1-5 bootstraps), and (ii) within a 5% genetic similarity. OTUs that are within the same clade can be distinguished as genetically and phylogenetically distinct from OTUs in a different clade based on 16S-V4 sequence data. OTUs falling within the same clade are evolutionarily closely related and may or may not be distinguishable from one another using 16S-V4 sequence data. The power of clade based analysis is that members of the same clade, due to their evolutionary relatedness, are likely to play similar functional roles in a microbial ecology such as that found in the human gut. Compositions substituting one species with another from the same clade are likely to have conserved ecological function and therefore are useful in the present invention.

Notably, 16S sequences of isolates of a given OTU are phylogenetically placed within their respective clades, sometimes in conflict with the microbiological-based assignment of species and genus that may have preceded 16S-based assignment. Discrepancies between taxonomic assignment based on microbiological characteristics versus genetic sequencing are known to exist from the literature.

Example 5

Germinating Spores

Mixtures of bacteria can include species that are in spore form. Germinating a spore fraction increases the number of viable bacteria that will grow on various media types. To germinate a population of spores, the sample is moved to the anaerobic chamber, resuspended in prereduced PBS, mixed and incubated for 1 hour at 37 C to allow for germination. Germinants can include amino-acids (e.g., alanine, glycine), sugars (e.g., fructose), nucleosides (e.g., inosine), bile salts (e.g., cholate and taurocholate), metal cations (e.g., $Mg^{2+}$, $Ca^{2+}$), fatty acids, and long-chain alkyl amines (e.g., dodecylamine, Germination of bacterial spores with alkyl primary amines" J. Bacteriology, 1961.). Mixtures of these or more complex natural mixtures, such as rumen fluid or Oxgall, can be used to induce germination. Oxgall is dehydrated bovine bile composed of fatty acids, bile acids, inorganic salts, sulfates, bile pigments, cholesterol, mucin, lecithin, glycuronic acids, porphyrins, and urea. The germination can also be performed in a growth medium like prereduced BHIS/oxgall germination medium, in which BHIS (Brain heart infusion powder (37 g/L), yeast extract (5 g/L), L-cysteine HCl (1 g/L)) provides peptides, amino acids, inorganic ions and sugars in the complex BHI and yeast extract mixtures and Oxgall provides additional bile acid germinants.

In addition, pressure may be used to germinate spores. The selection of germinants can vary with the microbe being sought. Different species require different germinants and different isolates of the same species can require different germinants for optimal germination. Finally, it is important to dilute the mixture prior to plating because some germinants are inhibitory to growth of the vegetative-state microorganisms. For instance, it has been shown that alkyl amines must be neutralized with anionic lipophiles in order to promote optimal growth. Bile acids can also inhibit growth of some organisms despite promoting their germination, and must be diluted away prior to plating for viable cells.

For example, BHIS/oxgall solution is used as a germinant and contains 0.5×BHIS medium with 0.25% oxgall (dehydrated bovine bile) where 1×BHIS medium contains the following per L of solution: 6 g Brain Heart Infusion from solids, 7 g peptic digest of animal tissue, 14.5 g of pancreatic digest of casein, 5 g of yeast extract, 5 g sodium chloride, 2 g glucose, 2.5 g disodium phosphate, and 1 g cysteine. Additionally, Ca-DPA is a germinant and contains 40 mM CaCl2, and 40 mM dipicolinic acid (DPA). Rumen fluid (Bar Diamond, Inc.) is also a germinant. Simulated gastric fluid (Ricca Chemical) is a germinant and is 0.2% (w/v) Sodium Chloride in 0.7% (v/v) Hydrochloric Acid. Mucin medium is a germinant and prepared by adding the following items to 1 L of distilled sterile water: 0.4 g $KH_2PO_4$, 0.53 g $Na_2HPO_4$, 0.3 g $NH_4Cl$, 0.3 g NaCl, 0.1 g $MgCl_2 \times 6H_2O$, 0.11 g $CaCl_2$, 1 ml alkaline trace element solution, 1 ml acid trace element solution, 1 ml vitamin solution, 0.5 mg resazurin, 4 g $NaHCO_3$, 0.25 g $Na_2S \times 9H_2O$. The trace element and vitamin solutions prepared as described previously (Stams et al., 1993). All compounds were autoclaved, except the vitamins, which were filter-sterilized. The basal medium was supplemented with 0.7% (v/v) clarified, sterile rumen fluid and 0.25% (v/v) commercial hog gastric mucin (Type III; Sigma), purified by ethanol precipitation as described previously (Miller & Hoskins, 1981). This medium is referred herein as mucin medium.

Fetal Bovine Serum (Gibco) can be used as a germinant and contains 5% FBS heat inactivated, in Phosphate Buffered Saline (PBS, Fisher Scientific) containing 0.137M Sodium Chloride, 0.0027M Potassium Chloride, 0.0119M Phosphate Buffer. Thioglycollate is a germinant as described previously (Kamiya et al Journal of Medical Microbiology 1989) and contains 0.25M (pH10) sodium thioglycollate. Dodecylamine solution containing 1 mM dodecylamine in PBS is a germinant. A sugar solution can be used as a germinant and contains 0.2% fructose, 0.2% glucose, and 0.2% mannitol. Amino acid solution can also be used as a germinant and contains 5 mM alanine, 1 mM arginine, 1 mM histidine, 1 mM lysine, 1 mM proline, 1 mM asparagine, 1 mM aspartic acid, 1 mM phenylalanine. A germinant mixture referred to herein as Germix 3 can be a germinant and contains 5 mM alanine, 1 mM arginine, 1 mM histidine, 1 mM lysine, 1 mM proline, 1 mM asparagine, 1 mM aspartic acid, 1 mM phenylalanine, 0.2% taurocholate, 0.2% fructose, 0.2% mannitol, 0.2% glucose, 1 mM inosine, 2.5 mM Ca-DPA, and 5 mM KCl. BHIS medium+ DPA is a germinant mixture and contains BHIS medium and 2 mM Ca-DPA. *Escherichia coli* spent medium supernatant referred to herein as EcSN is a germinant and is prepared by growing *E. coli* MG1655 in SweetB/Fos inulin medium anaerobically for 48 hr, spinning down cells at 20,000 rcf for 20 minutes, collecting the supernatant and heating to 60 C for 40 min. Finally, the solution is filter sterilized and used as a germinant solution.

Example 6

Selection of Media for Growth

It is important to select appropriate media to support growth, including preferred carbon sources. For example, some organisms prefer complex sugars such as cellobiose over simple sugars. Examples of media used in the isolation of sporulating organisms include EYA, BHI, BHIS, and GAM (see below for complete names and references). Multiple dilutions are plated out to ensure that some plates will have well isolated colonies on them for analysis, or alternatively plates with dense colonies may scraped and suspended in PBS to generate a mixed diverse community.

Plates are incubated anaerobically or aerobically at 37° C. for 48-72 or more hours, targeting anaerobic or aerobic spore formers, respectively.

Solid plate media include:
  Gifu Anaerobic Medium (GAM, Nissui) without dextrose supplemented with fructooligosaccharides/inulin (0.4%), mannitol (0.4%), inulin (0.4%), or fructose (0.4%), or a combination thereof.
  Sweet GAM [Gifu Anaerobic Medium (GAM, Nissui)] modified, supplemented with glucose, cellobiose, maltose, L-arabinose, fructose, fructooligosaccharides/inulin, mannitol and sodium lactate)

Brucella Blood Agar (BBA, Atlas, Handbook of Microbiological Media, 4th ed, ASM Press, 2010)
PEA sheep blood (Anaerobe Systems; 5% Sheep Blood Agar with Phenylethyl Alcohol)
Egg Yolk Agar (EYA) (Atlas, Handbook of Microbiological Media, 4th ed, ASM Press, 2010)
Sulfite polymyxin milk agar (Mevissen-Verhage et al., J. Clin. Microbiol. 25:285-289 (1987))
Mucin agar (Derrien et al., IJSEM 54: 1469-1476 (2004))
Polygalacturonate agar (Jensen & Canale-Parola, Appl. Environ. Microbiol. 52:880-997 (1986))
M2GSC (Atlas, Handbook of Microbiological Media, 4th ed, ASM Press, 2010)
M2 agar (Atlas, Handbook of Microbiological Media, 4th ed, ASM Press, 2010) supplemented with starch (1%), mannitol (0.4%), lactate (1.5 g/L) or lactose (0.4%)
Sweet B-Brain Heart Infusion agar (Atlas, Handbook of Microbiological Media, 4th ed, ASM Press, 2010) supplemented with yeast extract (0.5%), hemin, cysteine (0.1%), maltose (0.1%), cellobiose (0.1%), soluble starch (sigma, 1%), MOPS (50 mM, pH 7).
PY-salicin (peptone-yeast extract agar supplemented with salicin) (Atlas, Handbook of Microbiological Media, 4th ed, ASM Press, 2010).
Modified Brain Heart Infusion (M-BHI) contains the following per L: 37.5 g Brain Heart Infusion powder (Remel), 5 g yeast extract, 2.2 g meat extract, 1.2 g liver extract, 1g cystein HCl, 0.3 g sodium thioglycolate, 10 mg hemin, 2 g soluble starch, 2 g FOS/Inulin, 1 g cellobiose, 1 g L-arabinose, 1 g mannitol, 1 Na-lactate, 1 mL TWEEN® 80, 0.6 g $MgSO_4 \times 7H_2O$, 0.6 g $CaCl_2$, 6 g $(NH_4)_2 SO_4$, 3 g $KH_2 PO_4$, 0.5 g $K_2HPO_4$, 33 mM Acetic acid, 9 mM propionic acid, 1 mM Isobutyric acid, 1 mM isovaleric acid, 15 g agar, and after autoclaving add 50 mL of 8% $NaHCO_3$ solution and 50 mL 1M MOPS-KOH (pH 7).
Noack-Blaut *Eubacterium* agar (See Noack et al. J. Nutr. (1998) 128:1385-1391)
BHIS az1/ge2-BHIS az/ge agar (Reeves et. al. Infect. Immun. 80:3786-3794 (2012)) [Brain Heart Infusion agar (Atlas, Handbook of Microbiological Media, 4th ed, ASM Press, 2010) supplemented with yeast extract 0.5%, cysteine 0.1%, 0.1% cellobiose, 0.1% inulin, 0.1% maltose, aztreonam 1 mg/L, gentamycin 2 mg/L]
BHIS CInM az1/ge2-BHIS CInM [Brain Heart Infusion agar (Atlas, Handbook of Microbiological Media, 4th ed, ASM Press, 2010) supplemented with yeast extract 0.5%, cysteine 0.1%, 0.1% cellobiose, 0.1% inulin, 0.1% maltose, aztreonam 1 mg/L, gentamycin 2 mg/L]

Example 7

The Purification and Isolation of a Spore Forming Fraction from Feces

Figure 2:
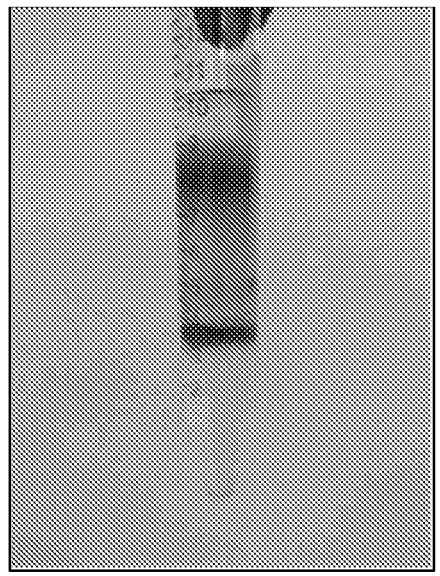
FIG. 2 shows a photograph of a CsCl gradient demonstrating the spore separation from other residual habitat material.
Figure 3:
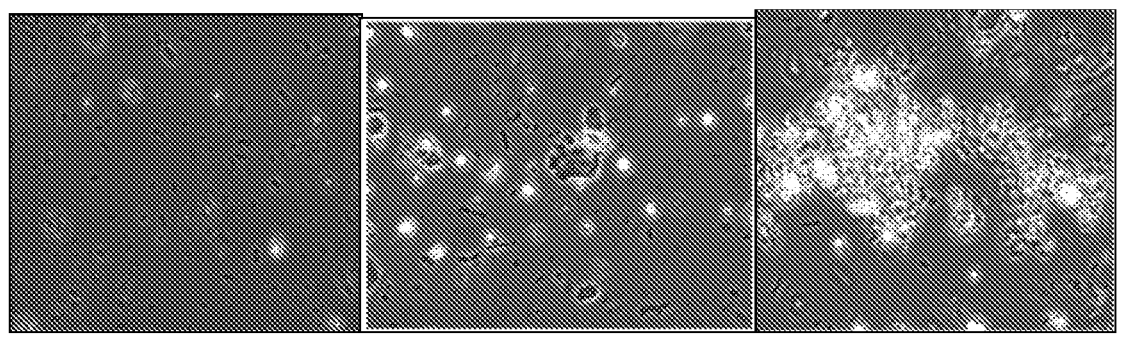
FIG. 3 shows three phase contrast image demonstrating the progressive enrichment of spores from a fecal suspension; ethanol treated, CsCl purified spore preparation; and an ethanol treated, CsCl purified, sucrose purified spore preparation.

To purify and selectively isolate efficacious spores from fecal material a donation is first blended with saline using a homogenization device (e.g., laboratory blender) to produce a 20% slurry (w/v). 100% ethanol is added for an inactivation treatment that lasts 10 seconds to 1 hour. The final alcohol concentration can range from 30-90%, preferably 50-70%. High speed centrifugation (3200 rcf for 10 min) is performed to remove solvent and the pellet is retained and washed. Subsequently, once the washed pellet is resuspended, a low speed centrifugation step (200 rcf for 4 min) is performed to remove large particulate vegetative matter and the supernatant containing the spores is retained. High speed centrifugation (3200 rcf for 10 min) is performed on the supernatant to concentrate the spore material. The pellet is then washed and resuspended to generate a 20% slurry. This is the ethanol treated spore preparation. The concentrated slurry is then separated with a density based gradient e.g. a CsCl gradient, sucrose gradient or combination of the two generating a ethanol treated, gradient-purified spore preparation. For example, a CsCl gradient is performed by loading a 20% volume of spore suspension on top a 80% volume of a stepwise CsCl gradient (w/v) containing the steps of 64%, 50%, 40% CsCl (w/v) and centrifuging for 20 min at 3200 rcf. The spore fraction is then run on a sucrose step gradient with steps of 67%, 50%, 40%, and 30% (w/v). When centrifuged in a swinging bucket rotor for 10 min at 3200 rcf. The spores run roughly in the 30% and 40% sucrose fractions. The lower spore fraction (FIG. 2) is then removed and washed to produce a concentrated ethanol treated, gradient-purified spore preparation. Taking advantage of the refractive properties of spores observed by phase contrast microscopy (spores are bright and refractive while germinated spores and vegetative cells are dark) one can see an enrichment of the spore fraction from a fecal bacterial cell suspension (FIG. 3, left) compared to an ethanol treated, CsCl gradient purified, spore preparation (FIG. 3, center), and to an ethanol treated, CsCl gradient purified, sucrose gradient purified, spore preparation (FIG. 3, right).

Furthermore, growth of spores after treatment with a germinant can also be used to quantify a viable spore population. Briefly, samples were incubated with a germinant (Oxgall, 0.25% for up to 1 hour), diluted and plated anaerobically on BBA (Brucella Blood Agar) or similar media (e.g. see Examples 5 and 6). Individual colonies were picked and DNA isolated for full-length 16S sequencing to identify the species composition (e.g. see Examples 3 and 4). Analysis revealed that 22 species were observed in total (Table 4) with a vast majority present in both the material purified with the gradient and without the gradient, indicating no or inconsequential shift in the ecology as a result of gradient purification. Spore yield calculations demonstrate an efficient recovery of 38% of the spores from the initial fecal material as measured by germination and plating of spores on BBA or measuring DPA count in the sample.

Example 8

Bacterial Compositions Prevent *C. difficile* Infection in a Mouse Model

To test the therapeutic potential of the bacterial composition such as but not limited to a spore population, a prophylactic mouse model of *C. difficile* infection (model based on Chen, et al., A mouse model of *Clostridium difficile* associated disease, Gastroenterology 135(6):1984-1992) was used. Two cages of five mice each were tested for each arm of the experiment. All mice received an antibiotic cocktail consisting of 10% glucose, kanamycin (0.5 mg/ml), gentamicin (0.044 mg/ml), colistin (1062.5 U/ml), metronidazole (0.269 mg/ml), ciprofloxacin (0.156 mg/ml), ampicillin (0.1 mg/ml) and Vancomycin (0.056 mg/ml) in their drinking water on days −14 through −5 and a dose of 10 mg/kg Clindamycin by oral gavage on day −3. On day −1, they received either the test article or vehicle control via oral gavage. On day 0 they were challenged by administration of approximately 4.5 log 10 cfu of *C. difficile* (ATCC 43255) via oral gavage. Optionally a positive control group received vancomycin from day −1 through day 3 in addition to the antibiotic protocol and *C. difficile* challenge specified above.

Feces were collected from the cages for analysis of bacterial carriage, mortality was assessed every day from day 0 to day 6 and the weight and subsequent weight change of the animal was assessed with weight loss being associated with *C. difficile* infection. Mortality and reduced weight loss of the test article compared to the vehicle were used to assess the success of the test article. Additionally, a *C. difficile* symptom scoring was performed each day from day −1 through day 6. Clinical Score was based on a 0-4 scale by combining scores for Appearance (0-2 pts based on normal, hunched, piloerection, or lethargic), and Clinical Signs (0-2 points based on normal, wet tail, cold-to-the-touch, or isolation from other animals).

In a naive control arm, animals were challenged with *C. difficile*. In the vancomycin positive control arm animals were dosed with *C. difficile* and treated with vancomycin from day −1 through day 3. The negative control was gavaged with PBS alone and no bacteria. The test arms of the experiment tested 1×, 0.1×, 0.01× dilutions derived from a single donor preparation of ethanol treated spores (e.g. see Example 7) or the heat treated feces prepared by treating a 20% slurry for 30 min at 80 C Dosing for CFU counts was determined from the final ethanol treated spores and dilutions of total spores were administered at 1×, 0.1×, 0.01× of the spore mixture for the ethanol treated fraction and a 1× dose for the heat treated fraction.

Weight loss and mortality were assessed on day 3. The negative control, treated with *C. difficile* only, exhibits 20% mortality and weight loss on Day 3, while the positive control of 10% human fecal suspension displays no mortality or weight loss on Day 3 (Table 5). EtOH-treated feces prevents mortality and weight loss at three dilutions, while the heat-treated fraction was protective at the only dose tested. These data indicate that the spore fraction is efficacious in preventing *C. difficile* infection in the mouse.

Example 9

The Prophylactic and Relapse Prevention Hamster Models

Previous studies with hamsters using toxigenic and non-toxigenic strains of *C. difficile* demonstrated the utility of the hamster model in examining relapse post antibiotic treatment and the effects of prophylaxis treatments with cecal flora in *C. difficile* infection (Wilson et al. 1981, Wilson et al. 1983, Borriello et al. 1985) and more broadly gastrointestinal infectious disease. To demonstrate prophylactic use of a bacterial composition such as but not limited to a spore population, spore preparation, vegetative cell population, to ameliorate *C. difficile* infection, the following hamster model is used. In a prophylactic model, Clindamycin (10 mg/kg s.c.) is given on day −5, the bacterial composition or control is administered on day −3, and *C. difficile* challenge occurs on day 0. In the positive control arm, vancomycin is then administered on day 1-5 (and vehicle control is delivered on day −3). Feces are collected on day −5, −4, −1, 1, 3, 5, 7, 9 and fecal samples are assessed for pathogen carriage and reduction by microbiological methods, 16S sequencing approaches or other methods utilized by one skilled in the art. Mortality is assessed throughout the experiment through 21 days post *C. difficile* challenge. The percentage survival curves show that ethanol treated spores and ethanol treated, gradient-purified spores better protect the hamsters compared to the Vancomycin control, and vehicle control.

Figure 4:
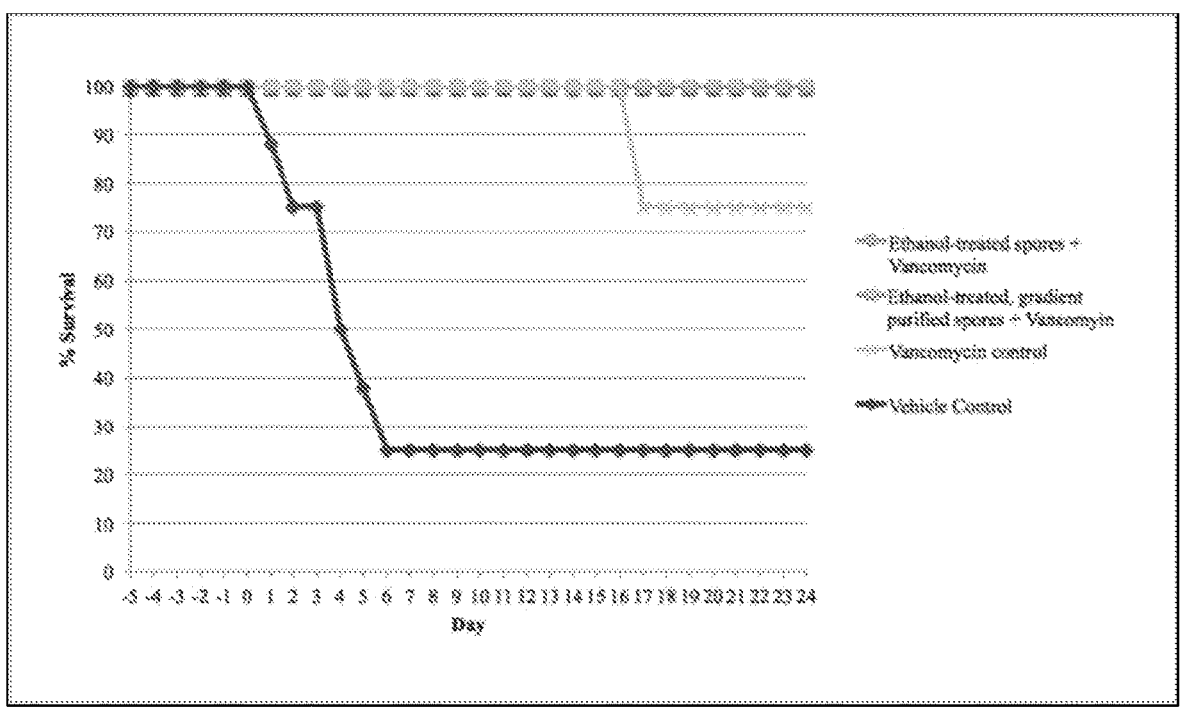
FIG. 4 shows a set of survival curves demonstrating efficacy of the spore population in a hamster prophylaxis model of C. difficile.

FIG. 4 shows prophylaxis model with the ethanol treated spore preparation and the ethanol treated, gradient-purified spore preparation.

In the relapse prevention model, hamsters are challenged with toxigenic *C. difficile* strains on day 0, and treated with clindamycin by oral gavage on day 1, and vancomycin dosing day 2-6. Test or control treatment was then administered on day 7, 8, and 9. The groups of hamsters for each arm consist of 8 hamsters per group. Fecal material is collected on day −1, 1, 3, 5, 7, 10 and 13 and hamster mortality is assessed throughout. Survival curves are used to assess the success of the test article e.g. ethanol treated or ethanol treated, gradient purified spores versus the control treatment in preventing hamster death. The survival curves demonstrate maximum efficacy for the ethanol treated, gradient-purified spores followed by the ethanol treated spores. Both treatments improved survival percentage over vancomycin treatment alone.

Figure 5:
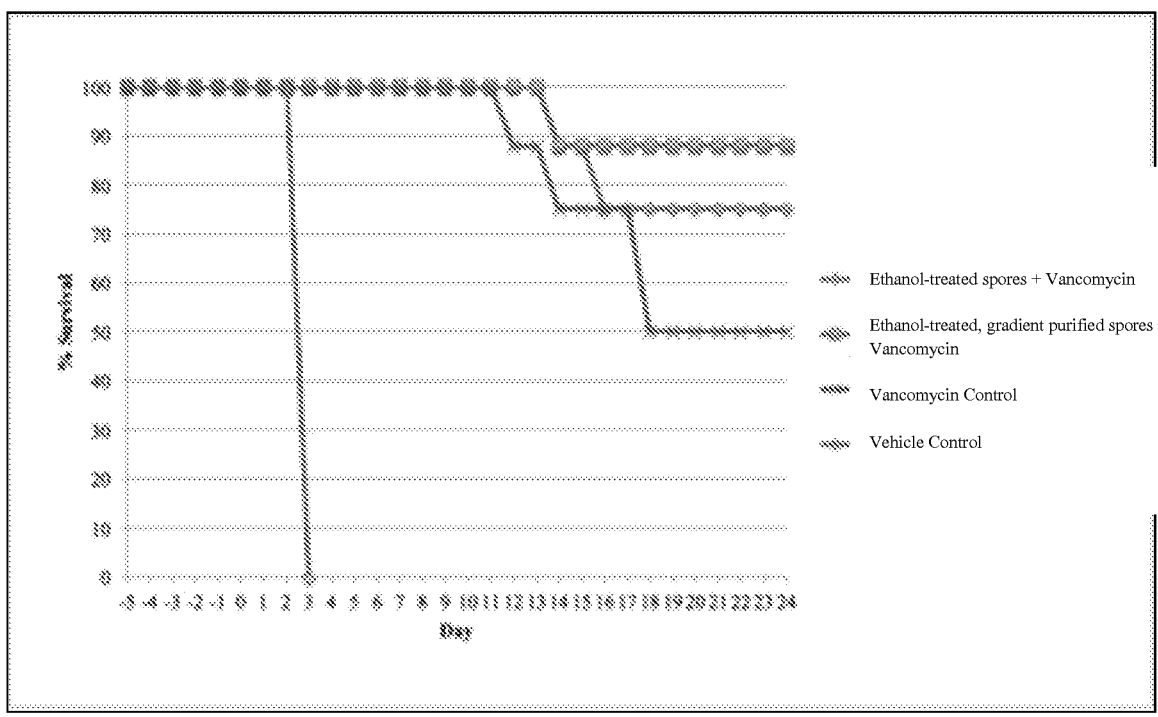
FIG. 5 provides a set of survival curves demonstrating efficacy of the spore population in a hamster relapse prevention model of C. difficile.

FIG. 5 shows relapse prevention model with ethanol treated spores and ethanol treated, gradient purified spores Example 10

Clinical Treatment of Recurrent *C. difficile* in Patients

To assess the efficacy of test articles like bacterial compositions including but not limited to a ethanol treated spore preparations (e.g. see Example 7) to treat recurrent *C. difficile* in human patients, the following procedure was performed to take feces from a healthy donor, inactivate via the ethanol treated spore preparation protocol described below, and treat recurrent *C. difficile* in patients presenting with this indication. Non-related donors were screened for general health history for absence of chronic medical conditions (including inflammatory bowel disease; irritable bowel syndrome; Celiac disease; or any history of gastrointestinal malignancy or polyposis), absence of risk factors for transmissible infections, antibiotic non-use in the previous 6 months, and negative results in laboratory assays for blood-borne pathogens (HIV, HTLV, HCV, HBV, CMV, HAV and *Treponema pallidum*) and fecal bacterial pathogens (*Salmonella, Shigella, Yersinia, Campylobacter, E. coli* O157), ova and parasites, and other infectious agents (*Giardia, Cryptosporidium Cyclospora, Isospora*) prior to stool donation.

Donor stool was frozen shortly after donation and sampled for testing. At the time of use, approximately 75 g of donor stool was thawed and resuspended in 500 mL of non-bacteriostatic normal saline and mixed in a single use glass or plastic blender. The resulting slurry was sequentially passed through sterile, disposable mesh screens that remove particles of size 600, 300 and 200 microns. The slurry was then centrifuged briefly (200 rcf for 4 min) to separate fibrous and particulate materials, and the supernatant (containing bacterial cells and spores) was transferred to a fresh container. Ethanol was added to a final concentration of 50% and the resulting ~1500 ml slurry was incubated at room temperature for 1 hr with continuous mixing to inactivate vegetative bacterial cells. Midway through inactivation the slurry was transferred to a new bottle to ensure complete contact with the ethanol. The solid matter was pelleted in a centrifuge and washed 3 times with normal saline to remove residual ethanol. The final pellet was resuspended in 100% sterile, USP glycerol at a minimum volume, and filled into approximately 30 size 0 delayed release capsules (hypromellose DRcaps, Capsugel, Inc.) at 0.65 mL suspension each.

The capsules were immediately capped and placed onto an aluminum freezing block held at −80° C. via dry ice to freeze. The frozen capsules were in turn over-capsulated with size 00 DRcaps to enhance capsule stability, labeled, and placed into <−65° C. storage immediately. The final product was stored at <−65° C. until the day and time of use. Encapsulated product may be stored for indefinitely at <−65° C. On the day of dosing capsules were warmed on wet ice for 1 to 2 hours to improve tolerability, and were then dosed with water ad libitium.

Patient 1 is a 45-year old woman with a history of *C. difficile* infection and diarrhea for at least 1 year prior to treatment. She has been previously treated with multiple courses of antibiotics followed each time by recurrence of *C. difficile*-associated diarrhea.

Patient 2 is an 81-year old female who has experienced recurrent *C. difficile* infection for 6 months prior to treatment despite adequate antibiotic therapy following each recurrence.

24 hours prior to starting oral treatment, CDAD antibiotic therapy was discontinued. Each patient received a colon preparation procedure intended to reduce the competing microbial burden in the gastrointestinal tract and to facilitate repopulation by the spore forming organisms in the investigational product.

On the morning of the first treatment day, the patients received a dose of delayed release capsules containing the investigational product with water ad libitum. Patients were requested to avoid food for 1 hour thereafter. The next day, the patient returned to the clinic to receive an additional dose. Patients were asked to avoid food for 4 hours prior to receiving their second dose and for 1 hour following dosing.

Both patients were followed closely for evidence of relapse or adverse symptoms following treatment. Patients were contacted by phone on Day 2, Day 4, and Weeks 1, 2 and 4 and each was queried about her general status and the condition of her CDAD and related symptoms. Stool samples were collected at baseline and Weeks 1, 2, 4 and 8 post-treatment to assess changes in the gut microbiota via 16S sequencing and spore count with methods explained previously (e.g. see Examples AAAB and AAAC). Through 4 weeks post treatment, each patient has gradually improved with no evidence of *C. difficile* recurrence.

Six other patients with recurrent *C. difficile*-associated diarrhea were treated in a similar fashion, with no CU recurrence and no requirement for resumption of antibiotics (total of 8 patients). Additionally, there were no treatment-related serious adverse events.

The above protocol could be modified to deliver other bacterial compositions e.g. vegetative cells, spore preparations, combinations thereof.

Example 11

Enrichment and Purification of Bacteria

To purify individual bacterial strains, dilution plates were selected in which the density enables distinct separation of single colonies. Colonies were picked with a sterile implement (either a sterile loop or toothpick) and re-streaked to BBA or other solid media. Plates were incubated at 37° C. for 3-7 days. One or more well-isolated single colonies of the major morphology type were re-streaked. This process was repeated at least three times until a single, stable colony morphology is observed. The isolated microbe was then cultured anaerobically in liquid media for 24 hours or longer to obtain a pure culture of $10^6$-$10^{10}$ cfu/ml. Liquid growth medium might include Brain Heart Infusion-based medium (Atlas, Handbook of Microbiological Media, 4th ed, ASM Press, 2010) supplemented with yeast extract, hemin, cysteine, and carbohydrates (for example, maltose, cellobiose, soluble starch) or other media described previously (e.g. see example 6). The culture was centrifuged at 10,000×g for 5 min to pellet the bacteria, the spent culture media was removed, and the bacteria were resuspended in sterile PBS. Sterile 75% glycerol was added to a final concentration of 20%. An aliquot of glycerol stock was titered by serial dilution and plating. The remainder of the stock was frozen on dry ice for 10-15 min and then placed at −80 C for long term storage.

Example 12

Cell Bank Preparation

Cell banks (RCBs) of bacterial strains were prepared as follows. Bacterial strains were struck from −80° C. frozen glycerol stocks to Brucella blood agar with Hemin or Vitamin K (Atlas, Handbook of Microbiological Media, 4th ed, ASM Press, 2010), M2GSC (Atlas, Handbook of Microbiological Media, 4th ed, ASM Press, 2010) or other solid growth media and incubated for 24 to 48 h at 37° C. in an anaerobic chamber with a gas mixture of $H_2$:$CO_2$:$N_2$ of 10:10:80. Single colonies were then picked and used to inoculate 250 ml to 1 L of Wilkins-Chalgren broth, Brain-Heart Infusion broth, M2GSC broth or other growth media, and grown to mid to late exponential phase or into the stationary phase of growth. Alternatively, the single colonies may be used to inoculate a pilot culture of 10 ml, which were then used to inoculate a large volume culture. The growth media and the growth phase at harvest were selected to enhance cell titer, sporulation (if desired) and phenotypes that might be associated desired in vitro or in vivo. Optionally, Cultures were grown static or shaking, depending which yielded maximal cell titer. The cultures were then concentrated 10 fold or more by centrifugation at 5000 rpm for 20 min, and resuspended in sterile phosphate buffered saline (PBS) plus 15% glycerol. 1 ml aliquots were transferred into 1.8 ml cryovials which were then frozen on dry ice and stored at −80 C The identity of a given cell bank was confirmed by PCR amplification of the 16S rDNA gene, followed by Sanger direct cycle sequencing, and comparison to a curated rDNA database to determine a taxonomic ID. Each bank was confirmed to yield colonies of a single morphology upon streaking to Brucella blood agar or M2GSC agar. When more than one morphology was observed, colonies were confirmed to be the expected species by PCR and sequencing analysis of the 16S rDNA gene. Variant colony morphologies can be observed within pure cultures, and in a variety of bacteria the mechanisms of varying colony morphologies have been well described (van der Woude, Clinical Microbiology Reviews, 17:518, 2004), including in *Clostridium* species (Wadsworth-KTL Anaerobic Bacteriology Manual, 6th Ed, Jousimie-Somer, et al 2002). For obligate anaerobes, RCBs were confirmed to lack aerobic colony forming units at a limit of detection of 10 cfu/ml.

Example 13

Titer Determination

The number of viable cells per ml was determined on the freshly harvested, washed and concentrated culture by plating serial dilutions of the RCB to Brucella blood agar or other solid media, and varied from 106 to 1010 cfu/ml. The impact of freezing on viability was determined by titering the banks after one or two freeze-thaw cycles on dry ice or at −80° C., followed by thawing in an anaerobic chamber at room temperature. Some strains displayed a 1-3 log drop in viable cfu/ml after the 1st and/or 2nd freeze thaw, while the viability of others were unaffected.

Example 14

Preparation of Bacterial Compositions

Individual strains were typically thawed on ice and combined in an anaerobic chamber to create mixtures, followed by a second freeze at −80° C. to preserve the mixed samples. When making combinations of strains for in vitro or in vivo assays, the cfu in the final mixture was estimated based on the second freeze-thaw titer of the individual strains. For experiments in rodents, strains may be combined at equal counts in order to deliver between 1e4 and 1e10 per strain. Additionally, some bacteria may not grow to sufficient titer to yield cell banks that allowed the production of compositions where all bacteria were present at 1e10.

Example 15

Provision of Out Microbiome Sample Material

For sourcing of microbial cultures and for use as a positive control in in vivo studies, fresh gut microbiome samples, e.g. fecal samples, were obtained from healthy human donors who have been screened for general good health and for the absence of infectious diseases, and meet inclusion and exclusion criteria, inclusion criteria include being in good general health, without significant medical history, physical examination findings, or clinical laboratory abnormalities, regular bowel movements with stool appearance typically Type 2, 3, 4, 5 or 6 on the Bristol Stool Scale, and having a BMI≥18 kg/m$^2$ and ≤25 kg/m$^2$. Exclusion criteria generally included significant chronic or acute medical conditions including renal, hepatic, pulmonary, gastrointestinal, cardiovascular, genitourinary, endocrine, immunologic, metabolic, neurologic or hematological disease, a family history of, inflammatory bowel disease including Crohn's disease and ulcerative colitis, Irritable bowel syndrome, colon, stomach or other gastrointestinal malignancies, or gastrointestinal polyposis syndromes, or recent use of yogurt or commercial probiotic materials in which an organism(s) is a primary component. Samples were collected directly using a commode specimen collection system, which contains a plastic support placed on the toilet seat and a collection container that rests on the support. Gut microbiome samples e.g. feces were deposited into the container, and the lid was then placed on the container and sealed tightly. The sample was then delivered on ice within 1-4 hours for processing. Samples were mixed with a sterile disposable tool, and 2-4 g aliquots were weighed and placed into tubes and flash frozen in a dry ice/ethanol bath. Aliquots are frozen at −80 degrees Celsius until use.

Optionally, the microbiome sample was suspended in a solution, and/or fibrous and/or particulate materials were removed. A frozen aliquot containing a known weight of sample was removed from storage at −80 degrees Celsius and allowed to thaw at room temperature. Sterile 1×PBS was added to create a 10% w/v suspension, and vigorous vortexing was performed to suspend the sample until the material appeared homogeneous. The sample was then left to sit for 10 minutes at room temperature to sediment fibrous and particulate matter. The suspension above the sediment was then carefully removed into a new tube and contains a purified spore population. Optionally, the suspension was then centrifuged at a low speed, e.g., 1000×g, for 5 minutes to pellet particulate matter including fibers. The pellet was discarded and the supernatant, which contained vegetative organisms and spores, was removed into a new tube. The supernatant was then centrifuged at 6000×g for 10 minutes to pellet the vegetative organisms and spores. The pellet was then resuspended in 1× PBS with vigorous vortexing until the sample material appears homogenous.

Example 16

Quantification of Spore Concentrations Using DPA Assay

Methods to assess spore concentration in complex mixtures typically require the separation and selection of spores and subsequent growth of individual species to determine the colony forming units. The art does not teach how to quantitatively germinate all the spores in a complex mixture as there are many species for which appropriate germinants have not been identified. Furthermore, sporulation is thought to be a stochastic process as a result of evolutionary selection, meaning that not all spores from a single species germinate with same response to germinant concentration, time and other environmental conditions. Alternatively, a key metabolite of bacterial spores, dipicolinic acid (DPA) has been developed to quantify spores particles in a sample and avoid interference from fecal contaminants. The assay utilizes the fact that DPA chelates Terbium 3+ to form a luminescent complex (Fichtel et al, FEMS Microbiology Ecology, 2007; Kort et al, Applied and Environmental Microbiology, 2005; Shafaat and Ponce, Applied and Environmental Microbiology, 2006; Yang and Ponce, International Journal of Food Microbiology, 2009; Hindle and Hall, Analyst, 1999). A time-resolved fluorescence assay detects terbium luminescence in the presence of DPA giving a quantitative measurement of DPA concentration in a solution.

To perform the assay 1 mL of the spore standard to be measured was transferred to a 2 mL microcentrifuge tube. The samples were centrifuged at 13000 RCF for 10 min and the sample is washed in 1 mL sterile deionized H$_2$O. Wash an additional time by repeating the centrifugation. Transfer the 1 mL solution to hungate tubes and autoclave samples on a steam cycle for 30 min at 250 C Add 100 uL of 30 uM TbCl$_3$ solution (400 mM sodium acetate, pH 5.0, 30 µM TbCl$_3$) to the sample. Make serial dilutions of of the autoclaved material and measure the fluorescence of each sample by exciting with 275 nm light and measuring the emission wavelength of 543 nm for an integration time of 1.25 ms and a 0.1 ms delay.

Purified spores are produced as described previously (e.g. see-www.epa.gov/pesticides/methods/MB-28-00.pdf).

Figure 6:
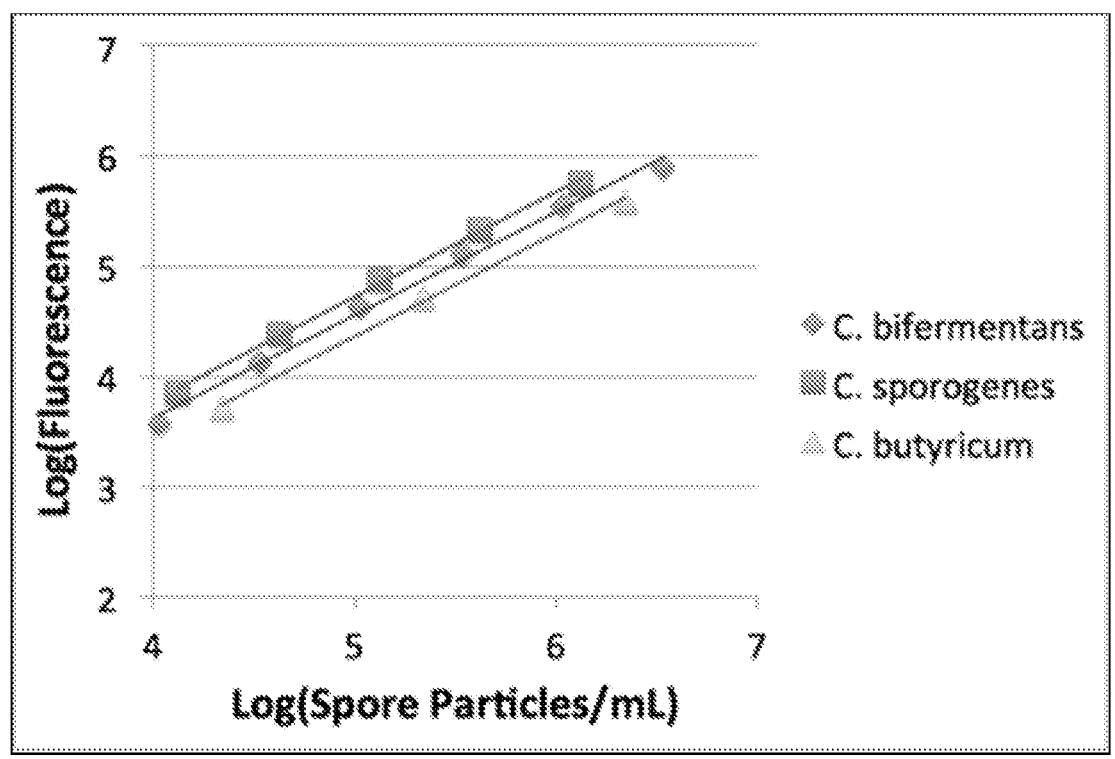
FIG. 6 shows the strong correlation and linear correspondence between the measurement of DPA concentration by a coupled fluorescence assay and the viable spore colony forming units.

Serial dilutions of purified spores from *C. bifermentans, C. sporogenes,* and *C. butyricum* cultures were prepared and measured by plating on BBA media and incubating overnight at 37C to determine CFU/ml. FIG. 6 shows the linear correspondence across different spore producing bacteria across several logs demonstrating the DPA assay as means to assess spore content (linear range of DPA assay compared to CFU counts/ml).

The discrepancy for complex spore populations between spore counts measured by germinable spore CFU and by DPA has important implications for determining the potency of an ethanol treated spore preparation for clinical use. Table 6 shows spore content data from 3 different ethanol treated spore preparations used to successfully treat 3 patients suffering from recurrent *C. difficile* infection. The spore content of each spore preparation is characterized using the two described methods.

What is immediately apparent is that spore content varies greatly per 30 capsules. As measured by germinable SCFU, spore content varies by greater than 10,000-fold. As measured by DPA, spore content varies by greater than 100-fold. In the absence of the DPA assay, it would be difficult to set a minimum dose for administration to a patient. For instance, without data from the DPA assay, one would conclude that a minimum effective dose of spores is $4 \times 10^5$ or less using the SCFU assay (e.g. Preparation 1, Table 7). If that SCFU dose was used to normalize dosing in a clinical setting, however, then the actual spore doses given to patients would be much lower for other ethanol treated spore preparations as measured as by the DPA assay (Table 7).

It becomes immediately obvious from the variability of SCFU and DPA counts across various donations that using SCFU as the measure of potency would lead to significant underdosing in certain cases. For instance, setting a dose specification of $4 \times 10^5$ SCFU (the apparent effective dose from donor Preparation 1) for product Preparation 3 would lead to a potential underdosing of more than 100-fold. This can be rectified only by setting potency specifications based on the DPA assay which better reflects total spore counts in an ethanol treated spore preparation. The unexpected finding of this work is that the DPA assay is uniquely suited to set potency and determine dosing for an ethanol treated spore preparation.

Example 17

Identification of Keystone OTUs and Functions

The human body is an ecosystem in which the microbiota, and the microbiome, play a significant role in the basic healthy function of human systems (e.g. metabolic, immunological, and neurological). The microbiota and resulting microbiome comprise an ecology of microorganisms that co-exist within single subjects interacting with one another and their host (i.e., the mammalian subject) to form a dynamic unit with inherent biodiversity and functional characteristics. Within these networks of interacting microbes (i.e. ecologies), particular members can contribute more significantly than others; as such these members are also found in many different ecologies, and the loss of these microbes from the ecology can have a significant impact on the functional capabilities of the specific ecology. Robert Paine coined the concept "Keystone Species" in 1969 (see Paine R T. 1969. A note on trophic complexity and community stability. The American Naturalist 103: 91-93.) to describe the existence of such lynchpin species that are integral to a given ecosystem regardless of their abundance in the ecological community. Paine originally describe the role of the starfish *Pisaster ochraceus* in marine systems and since the concept has been experimentally validated in numerous ecosystems.

Keystone OTUs and/or Functions are computationally-derived by analysis of network ecologies elucidated from a defined set of samples that share a specific phenotype. Keystone OTUs and/or Functions are defined as all Nodes within a defined set of networks that meet two or more of the following criteria. Using Criterion 1, the node is frequently observed in networks, and the networks in which the node is observed are found in a large number of individual subjects; the frequency of occurrence of these Nodes in networks and the pervasiveness of the networks in individuals indicates these Nodes perform an important biological function in many individuals. Using Criterion 2, the node is frequently observed in networks, and each the networks in which the node is observed contain a large number of Nodes—these Nodes are thus "super-connectors", meaning that they form a nucleus of a majority of networks and as such have high biological significance with respect to their functional contributions to a given ecology. Using Criterion 3, the node is found in networks containing a large number of Nodes (i.e. they are large networks), and the networks in which the node is found occur in a large number of subjects; these networks are potentially of high interest as it is unlikely that large networks occurring in many individuals would occur by chance alone strongly suggesting biological relevance. Optionally, the required thresholds for the frequency at which a node is observed in network ecologies, the frequency at which a given network is observed across subject samples, and the size of a given network to be considered a Keystone node are defined by the 50th, 70th, 80th, or 90th percentiles of the distribution of these variables. Optionally, the required thresholds are defined by the value for a given variable that is significantly different from the mean or median value for a given variable using standard parametric or non-parametric measures of statistical significance. In another embodiment a Keystone node is defined as one that occurs in a sample phenotype of interest such as but not limited to "health" and simultaneously does not occur in a sample phenotype that is not of interest such as but not limited to "disease." Optionally, a Keystone Node is defined as one that is shown to be significantly different from what is observed using permuted test datasets to measure significance.

Example 18

Prophylactic Use and Treatment in a Mouse Model of Vancomycin Resistant *Enterococcus* (VRE) Colonization The emergence and spread of highly antibiotic-resistant bacteria represent a major clinical challenge (Snitkin et al Science Translational Medicine, 2012). In recent years, the numbers of infections caused by organisms such as methicillin-resistant *Staphylococcus aureus*, carbapenem-resistant *Enterobacteriaceae*, vancomycin-resistant *Enterococcus* (VRE), and *Clostridium difficile* have increased markedly, and many of these strains are acquiring resistance to the few remaining active antibiotics. Most infections produced by highly antibiotic-resistant bacteria are acquired during hospitalizations, and preventing patient-to-patient transmission of these pathogens is one of the major challenges confronting hospitals and clinics. Most highly antibiotic-resistant bacterial strains belong to genera that colonize mucosal surfaces, usually at low densities. The highly complex microbiota that normally colonizes mucosal surfaces inhibits expansion of and domination by bacteria such as Enterobacteriaceae and *Enterococcaceae*. Destruction of the normal flora by antibiotic administration, however, disinhibition antibiotic-resistant members of these bacterial families, leading to their expansion to very high densities (Ubeda et al Journal of Clinical Investigation 2010). High-density colonization by these organisms can be calamitous for the susceptible patient, resulting in bacteremia and sepsis (Taur et al, Clinical Infectious Disease, 2012).

To test prophylactic use and treatment of a bacterial composition test article, a VRE infection mouse model is used as previously described (Ubeda et al, Infectious Immunity 2013, Ubeda et al, Journal of clinical investigation, 2010). Briefly, experiments are done with 7-week-old C57BL/6 J female mice purchased from Jackson Laboratory, housed with irradiated food, and provided with acidified water. Mice are individually housed to avoid contamination between mice due to coprophagia. For experimental infections with VRE, mice are treated with ampicillin (0.5 g/liter) in their drinking water, which is changed every 3 days.

In the treatment model, on day 1, mice are infected by means of oral gavage with 108 CFU of the vancomycin-resistant *Enterococcus faecium* strain purchased from ATCC (ATCC 700221). One day after infection (day 1), antibiotic treatment is stopped and VRE levels are determined at different time points by plating serial dilutions of fecal pellets on Enterococcosel agar plates (Difco) with vancomycin (8 ug/ml; Sigma). VRE colonies are identified by appearance and confirmed by Gram staining or other methods previously described (e.g. see examples 2, 3 and 4). In addition, as previously described (Ubeda et al, Journal of Clinical Investigation 2010), PCR of the vanA gene, which confers resistance to vancomycin, confirms the presence of VRE in infected mice. The bacterial composition test article such as but not limited to an ethanol treated, gradient purified spore preparation (as described herein), fecal suspension, or antibiotic treatment is delivered in PBS on days 1-3 while the negative control contains only PBS and is also delivered on days 1-3 by oral gavage. Fresh fecal stool pellets are obtained daily for the duration of the experiment from days −7 to day 10. The samples are immediately frozen and stored at −80° C. DNA was extracted using standard techniques and analyzed with 16S or comparable methods (e.g. see example 3 and 4).

In the colonization model, ampicillin is administered as described above for day −7 to day 1, treatment with the test article or vehicle control is administered on day 0-2 and the VRE resistant bacteria at 108 CFU are administered on day 14. Fecal samples are taken throughout the experiment daily from −7 to day 21 and submitted for 16S sequencing as previously described (e.g. see examples 3 and 4).

In both models titers of VRE in feces are used to evaluate the success of the test article versus the negative control. Furthermore, microbiota composition is assessed for the ability of the bacterial composition test article to induce a healthy microbiome.

Example 19

Prophylactic Use and Treatment of a Mouse Model of Carbapenem Resistant *Klebsiella* (CRKB) Colonization The emergence of *Klebsiella pneumoniae* strains with decreased susceptibility to carbapenems is a significant threat to hospitalized patients. Resistance to carbapenems in these organisms is most frequently mediated by *K. pneumoniae* carbapenemase (KPC), a class A beta-lactamase that also confers resistance to broad-spectrum cephalosporins and commercially available beta-lactam/beta-lactamase inhibitor combinations (Queenan et al, Clinical Microbiology Review, 2007). KPC-producing *K. pneumoniae* (KPC-Kp) strains often harbor resistance determinants against several other classes of antimicrobials, including aminoglycosides and fluoroquinolones, resulting in truly multidrug-resistant (MDR) organisms (Hirsch et al, Journal of Antimicrobial Chemotherapy, 2009). Considering the limited antimicrobial options, infections caused by KPC-Kp pose a tremendous therapeutic challenge and are associated with poor clinical outcomes A treatment protocol in a mouse model as previously described (e.g. Perez et al, Antimicrobial Agents Chemotherapy, 2011) is used to evaluate the bacterial composition (test article) for treating carbapenem resistant *Klebsiella* and reducing carriage in the GI tract. Female CF1 mice (Harlan Sprague-Dawley, Indianapolis, Ind.) are used and are individually housed and weighed between 25 and 30 g.

The thoroughly characterized strain of *K. pneumoniae*, VA-367 (8, 9, 25) is used in this study. This clinical isolate is genetically related to the KPC-Kp strain circulating in the Eastern United States. Characterization of the resistance mechanisms in *K. pneumoniae* VA-367 with PCR and DNA sequence analysis revealed the presence of $bla_{KPC-3}$, $bla_{TEM-1}$, $bla_{SHV-11}$, and $bla_{SHV-12}$ as well as qnrB19 and aac(6')-lb. Additionally, PCR and DNA sequencing revealed disruptions in the coding sequences of the following outer membrane protein genes: ompK35, ompK36, and ompK37. Antibiotic susceptibility testing (AST) was performed with the agar dilution method and interpreted according to current recommendations from the Clinical and Laboratory Standards Institute (CLSI). A modified Hodge test were performed, according to a method described previously (e.g. see Anderson et al, Journal of Clinical Microbiology, 2007) with ertapenem, meropenem, and imipenem. Tigecycline and polymyxin E were evaluated by Etest susceptibility assays (AB bioM'erieux, Solna, Sweden). Results for tigecycline were interpreted as suggested by the U.S. Food and Drug Administration (FDA) and according to CLSI recommendations (criteria for *Pseudomonas*) for polymyxin E.

Mice (10 per group) are assigned to either a bacterial composition (test article), ethanol treated, spore preparation (e.g. see example 7), antibiotic clindamycin, piperacillin-tazobactam, tigecycline, ertapenem, cefepime, ciprofloxacin, or combination thereof or control group receiving only the vehicle. They are administered the test article daily from day −10 to day 0, On day 0, $10^3$ CFU of KPC-Kp VA-367 diluted in 0.5 ml phosphate-buffered saline (PBS) was administered by oral gavage using a stainless-steel feeding tube (Perfektum; Popper & Sons, New Hyde Park, N.Y.). Stool samples were collected 1, 4, 6, and 11 days after the administration of KPC-Kp in order to measure the concentration of carbapenem-resistant *K. pneumoniae*. Stool samples (100 mg diluted in 800 ml of PBS) are plated onto MacConkey agar with and without 0.5 ug/ml of imipenem, and the number of CFU per gram of stool was determined. Alternatively other methods may be used to measure the levels of carbapenem-resistant *K. pneumoniae* e.g. per, antigen testing, as one who's skilled in the art could perform.

Stool samples were collected after 5 days of treatment to assess the effects of the antibiotics on the stool microflora and to measure antibiotic levels in stool. To assess the effects on the microflora, fresh stool samples as previously described (e.g. see examples AAAB and AAAC). Additional experiments are performed to examine whether the administration the bacterial composition (test article) resulted in the elimination or persistence of colonization with KPC-Kp VA-367.

Mice are treated with subcutaneous clindamycin to reduce the normal intestinal flora 1 day before receiving 104 CFU of KPC-Kp VA-367 by oral gavage, and the mice continued to receive subcutaneous clindamycin every other day for 7 days. Concurrently, for 7 days after oral gavage with KPC-Kp, mice received oral gavage of normal saline (control group), or the bacterial composition as specified. An additional dose of subcutaneous clindamycin was administered 20 days after the administration of KPC-Kp VA-367 to assess whether low levels of carbapenem-resistant *K. pneumoniae* were present that could be augmented by the elimination of the anaerobic microflora. Stool samples were collected at baseline and at 3, 6, 8, 11, 16, and 21 days after KPC-Kp VA-367 was given by gavage. The bacterial composition will be examined by the reduction of CRKB in feces.

Example 20

Methods of Construction and Quantification

Construction of Binary Pairs in a High-Throughput 96-Well Format.

To allow high-throughput screening of binary pairs, vials of −80° C. glycerol stock banks were thawed and diluted to 1e8 CFU/mL. Each strain was then diluted 10× (to a final concentration of 1e7 CFU/mL of each strain) into 200 uL of PBS+15% glycerol in the wells of a 96-well plate. Plates were then frozen at −80° C. When needed, plates were removed from −80° C. and thawed at room temperature under anaerobic conditions when testing in an In vitro inhibition assay with *Clostridium difficile*.

Construction of Ternary Combinations in a High-Throughput 96-Well Format

To allow high-throughput screening of ternary combinations, vials of −80° C. glycerol stock banks were thawed and diluted to 1e8 CFU/mL. Each strain was then diluted 10× (to a final concentration of 1e7 CFU/mL of each strain) into 200 uL of PBS+15% glycerol in the wells of a 96-well plate. Plates were then frozen at −80° C. When needed for the assay, plates were removed from −80° C. and thawed at room temperature under anaerobic conditions when testing in an In vitro inhibition assay with *Clostridium difficile*.

Construction of an In Vitro Inhibition Assay to Screen for Ecobiotic™ Compositions Inhibitory to the Growth of *Clostridium difficile*

An overnight culture of *Clostridium difficile* was grown under anaerobic conditions in SweetB-FosIn or other suitable media for the growth of *C. difficile*. SweetB-FosIn is a complex media composed of brain heart infusion, yeast extract, cysteine, cellobiose, maltose, soluble starch, and fructooligosaccharides/inulin, and hemin, and is buffered with MOPs. After 24 hr of growth the culture was diluted 100,000 fold into a complex media such as SweetB-FosIn which is suitable for the growth of a wide variety of anaerobic bacterial species. The diluted *C. difficile* mixture was then aliquoted to wells of a 96-well plate (180 uL to each well). 20 uL of a unique binary pair of potential inhibitory species was then added to each well at a final concentration of 1e6 CFU/mL of each species. Alternatively the assay can be tested with binary pairs at different initial concentrations (1e9 CFU/mL, 1e8 CFU/mL, 1e7 CFU/mL, 1e5 CFU/mL, 1e4 CFU/mL, 1e3 CFU/mL, 1e2 CFU/mL). Control wells only inoculated with *C. difficile* were included for a comparison to the growth of *C. difficile* without inhibition. Additional wells were used for controls that either inhibit or do not inhibit the growth of *C. difficile*. One example of a positive control that inhibits growth was a combination of Blautia *producta*, Clostridium *bifermentans* and *Escherichia coli*. One example of a control that shows reduced inhibition of *C. difficile* growth as a combination of Bacteroides *thetaiotaomicron*, Bacteroides *ovatus* and Bacteroides *vulgatus*. Plates were wrapped with parafilm and incubated for 24 hr at 37° C. under anaerobic conditions. After 24 hr the wells containing *C. difficile* alone were serially diluted and plated to determine titer. The 96-well plate was then frozen at −80 C before quantifying *C. difficile* by qPCR assay.

Construction of an In Vitro Inhibition Assay to Screen for Bacterial Compositions that Produce Diffusible Products Inhibitory to the Growth of *Clostridium difficile* Using a Filter Insert.

The In vitro inhibition assay described above was modified by using a 0.22 uM filter insert (Millipore™ MultiScreen™ 96-Well Assay Plates—Item MAGVS2210) in 96-well format to physically separate *C. difficile* from the bacterial compositions. The *C. difficile* was aliquoted into the 96-well plate while the bacterial compositions were aliquoted into media on the filter overlay. The nutrient media as in contact on both sides of the 0.22 uM filter, allowing exchange of nutrients, small molecules and many macromolecules (e.g., bacteriocins, cell-surface proteins, or polysaccharides) by diffusion. In this embodiment, after 24 hr incubation, the filter insert containing the bacterial compositions was removed. The plate containing *C. difficile* was then transferred to a 96-well plate reader suitable for measuring optical density (OD) at 600 nm. The growth of *C. difficile* in the presence of different bacterial compositions was compared based on the OD measurement.

Construction of an In Vitro Inhibition Assay to Screen for Bacterial Compositions Inhibitory to the Growth of *Clostridium difficile* Using *Clostridium difficile* Selective Media for Quantification The In vitro inhibition assay described above can be modified to determine final *C. difficile* titer by serially diluting and plating to *C. difficile* selective media (Bloedt et al 2009) such as CCFA (cycloserine cefoxitin fructose agar, Anaerobe Systems), CDSA (*Clostridium difficile* selective agar, which is cycloserine cefoxitin mannitol agar, Becton Dickinson).

Quantification of *C. difficile* Using Quantitative PCR (qPCR) Standard Curve Preparation The standard curve was generated from a well on each assay plate containing only pathogenic *C. difficile* grown in SweetB+FosIn media as provided herein and quantified by selective spot plating. Serial dilutions of the culture were performed in sterile phosphate-buffered saline. Genomic DNA was extracted from the standard curve samples along with the other wells.

Genomic DNA Extraction

Genomic DNA was extracted from 5 µl of each sample using a dilution, freeze/thaw, and heat lysis protocol. 5 µL of thawed samples were added to 45 µL of UltraPure water (Life Technologies, Carlsbad, Calif.) and mixed by pipetting. The plates with diluted samples were frozen at −20° C. until use for qPCR which includes a heated lysis step prior to amplification. Alternatively the genomic DNA could be isolated using the Mo Bio Powersoil®-htp 96 Well Soil DNA Isolation Kit (Mo Bio Laboratories, Carlsbad, Calif.), Mo Bio Powersoil® DNA Isolation Kit (Mo Bio Laboratories, Carlsbad, Calif.), or the QIAamp DNA Stool Mini Kit (QIAGEN, Valencia, Calif.) according to the manufacturer's instructions.

qPCR Composition and Conditions

The qPCR reaction mixture contained 1x SsoAdvanced Universal Probes Supermix, 900 nM of Wr-tcdB-F primer (AGCAGTTGAATATAGTGGTTTAGTTAGAGTTG (SEQ ID NO: 2040), IDT, Coralville, Iowa), 900 nM of Wr-tcdB-R primer (CATGCTTTTTAGTTTCTGGATTGAA (SEQ ID NO: 2041), IDT, Coralville, Iowa), 250 nM of Wr-tcdB-P probe (6FAM-CATCCAGTCTCAAT-TGTATATGTTTCTCCA-MGB (SEQ ID NO: 2042), Life Technologies, Grand Island, N.Y.), and Molecular Biology Grade Water (Mo Bio Laboratories, Carlsbad, Calif.) to 18 µl (Primers adapted from: Wroblewski, D. et al., Rapid Molecular Characterization of *Clostridium difficile* and Assessment of Populations of *C. difficile* in Stool Specimens, Journal of Clinical Microbiology 47:2142-2148 (2009)). This reaction mixture was aliquoted to wells of a Hard-shell Low-Profile Thin Wall 96-well Skirted PCR Plate (BioRad, Hercules, Calif.). To this reaction mixture, 2 µl of diluted, frozen, and thawed samples were added and the plate sealed with a Microseal '13' Adhesive Seal (BioRad, Hercules, Calif.). The qPCR was performed on a BioRad C1000™ Thermal Cycler equipped with a CFX96®Real-Time System (BioRad, Hercules, Calif.). The thermocycling conditions were 95° C. for 15 minutes followed by 45 cycles of 95° C. for 5 seconds, 60° C. for 30 seconds, and fluorescent readings of the FAM channel. Alternatively, the qPCR could be performed with other standard methods known to those skilled in the art.

Data Analysis

The Cq value for each well on the FAM channel was determined by the CFX Manager™ 3.0 software. The $\log_{10}$ (cfu/mL) of *C. difficile* each experimental sample was calculated by inputting a given sample's Cq value into a linear regression model generated from the standard curve comparing the Cq values of the standard curve wells to the known $\log_{10}$(cfu/mL) of those samples. The log inhibition was calculated for each sample by subtracting the $\log_{10}$(cfu/mL) of *C. difficile* in the sample from the $\log_{10}$(cfu/mL) of *C. difficile* in the sample on each assay plate used for the generation of the standard curve that has no additional bacteria added. The mean log inhibition was calculated for all replicates for each composition.

A histogram of the range and standard deviation of each composition was plotted. Ranges or standard deviations of the log inhibitions that were distinct from the overall distribution were examined as possible outliers. If the removal of a single log inhibition datum from one of the binary pairs that were identified in the histograms would bring the range or standard deviation in line with those from the majority of the samples, that datum was removed as an outlier, and the mean log inhibition was recalculated.

The pooled variance of all samples evaluated in the assay was estimated as the average of the sample variances weighted by the sample's degrees of freedom. The pooled standard error was then calculated as the square root of the pooled variance divided by the square root of the number of samples. Confidence intervals for the null hypothesis were determined by multiplying the pooled standard error to the z score corresponding to a given percentage threshold. Mean log inhibitions outside the confidence interval were considered to be inhibitory if positive or stimulatory if negative with the percent confidence corresponding to the interval used. Samples with mean log inhibition greater than the 99% confidence interval (C.I) of the null hypothesis are reported as ++++, those with a 95%<C.I. <99% as +++, those with a 90%<C.I. <95% as ++, those with a 80%<C.I. <90% as + while samples with mean log inhibition less than than the 99% confidence interval (C.I) of the null hypothesis are reported as ----, those with a 95%<C.I. <99% as ---, those with a 90%<C.I. <95% as --, those with a 80%<C.I. <90% as -.

Many binary pairs inhibit *C. difficile* Table 8. 622 of 989 combinations show inhibition with a confidence interval >80%; 545 of 989 with a C.I. >90%; 507 of 989 with a C.I. >95%; 430 of 989 with a C.I. of >99%. Non-limiting but exemplary binary pairs include those with mean log reduction greater than 0.366, e.g. *Allistipes shahii* paired with *Blautia producta, Clostridium hathaweyi*, or *Colinsella aerofaciens*, or *Clostidium mayombei* paired with *C. innocuum, C. tertium, Colinsella aerofaciens*, or any of the other 424 combinations shown in Table 8. Equally important, the In vitro inhibition assay describes binary pairs that do not effectively inhibit *C. difficile*. 188 of 989 combinations promote growth with >80% confidence; 52 of 989 show a lack of inhibition with >90% confidence; 22 of 989 show a lack of inhibition with >95% confidence; 3 of 989, including *B. producta* combined with *Coprococcus catus, Alistipes shahii* combined with *Dorea formicigenerans*, and *Eubacterium rectale* combined with *Roseburia intestinalis*, show a lack of inhibition with >99% confidence. 249 of 989 combinations are neutral in the assay, meaning they neither promote nor inhibit *C. difficile* growth to the limit of measurement.

Ternary combinations with mean log inhibition greater than 0.312 are reported as ++++99% confidence interval (C.I.) of the null hypothesis), those with mean log inhibition between 0.221 and 0.312 as +++(95%<C.I. <99%), those with mean log inhibition between 0.171 and 0.221 as ++(90%<C.I. <95%), those with mean log inhibition between 0.113 and 0.171 as +(80%<C.I. <90%), those with mean log inhibition between −0.113 and −0.171 as −(80%<C.I. <90%), those with mean log inhibition between −0.171 and −0.221 as −−(90%<C.I. <95%), those with mean log inhibition between −0.221 and −0.312 as −−−(95%<C.I. <99%), and those with mean log inhibition less than −0.312 as −−−−(99%<C.I.).

The In vitro inhibition assay shows that many ternary combinations inhibit *C. difficile*. 39 of 56 combinations show inhibition with a confidence interval >80%; 36 of 56 with a C.I. >90%; 36 of 56 with a C.I. >95%; 29 of 56 with a C.I. of >99%. Non-limiting but exemplary ternary combinations include those with mean log reduction greater than 0.171, e.g. any combination shown in Table 9 with a score of ++++, such as *Colinsella aerofaciens, Coprococcus comes*, and *Blautia producta*. Equally important, the In vitro inhibition assay describes ternary combinations that do not effectively inhibit *C. difficile*. 5 of 56 combinations promote growth with >80% confidence; 2 of 56 promote growth with >90% confidence; 1 of 56, *Coprococcus comes, Clostridium symbiosum* and *Eubacterium rectale*, promote growth with >95% confidence. 12 of 56 combinations are neutral in the assay, meaning they neither promote nor inhibit *C. difficile* growth to the limit of measurement.

Unless otherwise indicated, all numbers expressing quantities of ingredients, reaction conditions, and so forth used in the specification, including claims, are to be understood as being modified in all instances by the term "about." Accordingly, unless otherwise indicated to the contrary, the numerical parameters are approximations and may vary depending upon the desired properties sought to be obtained. At the very least, and not as an attempt to limit the application of the doctrine of equivalents to the scope of the claims, each numerical parameter should be construed in light of the number of significant digits and ordinary rounding approaches.

Unless otherwise indicated, the term "at least" preceding a series of elements is to be understood to refer to every element in the series.

While the invention has been particularly shown and described with reference to a preferred embodiment and various alternate embodiments, it will be understood by persons skilled in the relevant art that various changes in form and details can be made therein without departing from the spirit and scope of the invention.

All references, issued patents and patent applications cited within the body of the instant specification are hereby incorporated by reference in their entirety, for all purposes.

TABLES

TABLE 1

List of Operational Taxonomic Units (OTU) with taxonomic assignments made to Genus, Species, and Phylogenetic Clade.

| OTU | SEQ ID Number | Public DB Accession | Clade | Spore Former | Pathogen Status |
|---|---|---|---|---|---|
| *Eubacterium saburreum* | 858 | AB525414 | clade_178 | Y | N |
| *Eubacterium* sp. oral clone IR009 | 866 | AY349376 | clade_178 | Y | N |
| Lachnospiraceae bacterium ICM62 | 1061 | HQ616401 | clade_178 | Y | N |
| Lachnospiraceae bacterium MSX33 | 1062 | HQ616384 | clade_178 | Y | N |
| Lachnospiraceae bacterium oral taxon 107 | 1063 | ADDS01000069 | clade_178 | Y | N |
| *Alicyclobacillus acidocaldarius* | 122 | NR_074721 | clade_179 | Y | N |
| *Clostridium baratii* | 555 | NR_029229 | clade_223 | Y | N |
| *Clostridium colicanis* | 576 | FJ957863 | clade_223 | Y | N |
| *Clostridium paraputrificum* | 611 | AB536771 | clade_223 | Y | N |
| *Clostridium sardiniense* | 621 | NR_041006 | clade_223 | Y | N |
| *Eubacterium budayi* | 837 | NR_024682 | clade_223 | Y | N |
| *Eubacterium moniliforme* | 851 | HF558373 | clade_223 | Y | N |
| *Eubacterium multiforme* | 852 | NR_024683 | clade_223 | Y | N |
| *Eubacterium nitritogenes* | 853 | NR_024684 | clade_223 | Y | N |
| *Anoxybacillus flavithermus* | 173 | NR_074667 | clade_238 | Y | N |
| *Bacillus aerophilus* | 196 | NR_042339 | clade_238 | Y | N |
| *Bacillus aestuarii* | 197 | GQ980243 | clade_238 | Y | N |
| *Bacillus amyloliquefaciens* | 199 | NR_075005 | clade_238 | Y | N |
| *Bacillus anthracis* | 200 | AAEN01000020 | clade_238 | Y | Category-A |
| *Bacillus atrophaeus* | 201 | NR_075016 | clade_238 | Y | OP |
| *Bacillus badius* | 202 | NR_036893 | clade_238 | Y | OP |
| *Bacillus cereus* | 203 | ABDJ01000015 | clade_238 | Y | OP |
| *Bacillus circulans* | 204 | AB271747 | clade_238 | Y | OP |
| *Bacillus firmus* | 207 | NR_025842 | clade_238 | Y | OP |
| *Bacillus flexus* | 208 | NR_024691 | clade_238 | Y | OP |
| *Bacillus fordii* | 209 | NR_025786 | clade_238 | Y | OP |
| *Bacillus halmapalus* | 211 | NR_026144 | clade_238 | Y | OP |
| *Bacillus herbersteinensis* | 213 | NR_042286 | clade_238 | Y | OP |
| *Bacillus idriensis* | 215 | NR_043268 | clade_238 | Y | OP |
| *Bacillus lentus* | 216 | NR_040792 | clade_238 | Y | OP |
| *Bacillus licheniformis* | 217 | NC_006270 | clade_238 | Y | OP |
| *Bacillus megaterium* | 218 | GU252124 | clade_238 | Y | OP |
| *Bacillus nealsonii* | 219 | NR_044546 | clade_238 | Y | OP |
| *Bacillus niabensis* | 220 | NR_043334 | clade_238 | Y | OP |
| *Bacillus niacini* | 221 | NR_024695 | clade_238 | Y | OP |
| *Bacillus pocheonensis* | 222 | NR_041377 | clade_238 | Y | OP |
| *Bacillus pumilus* | 223 | NR_074977 | clade_238 | Y | OP |
| *Bacillus safensis* | 224 | JQ624766 | clade_238 | Y | OP |
| *Bacillus simplex* | 225 | NR_042136 | clade_238 | Y | OP |
| *Bacillus sonorensis* | 226 | NR_025130 | clade_238 | Y | OP |
| *Bacillus* sp. 10403023 MM10403188 | 227 | CAET01000089 | clade_238 | Y | OP |
| *Bacillus* sp. 2_A_57_CT2 | 230 | ACWD01000095 | clade_238 | Y | OP |
| *Bacillus* sp. 2008724126 | 228 | GU252108 | clade_238 | Y | OP |
| *Bacillus* sp. 2008724139 | 229 | GU252111 | clade_238 | Y | OP |
| *Bacillus* sp. 7_16AIA | 231 | FN397518 | clade_238 | Y | OP |
| *Bacillus* sp. AP8 | 233 | JX101689 | clade_238 | Y | OP |
| *Bacillus* sp. B27(2008) | 234 | EU362173 | clade_238 | Y | OP |
| *Bacillus* sp. BT1B_CT2 | 235 | ACWC01000034 | clade_238 | Y | OP |
| *Bacillus* sp. GB1.1 | 236 | FJ897765 | clade_238 | Y | OP |
| *Bacillus* sp. GB9 | 237 | FJ897766 | clade_238 | Y | OP |
| *Bacillus* sp. HU19.1 | 238 | FJ897769 | clade_238 | Y | OP |
| *Bacillus* sp. HU29 | 239 | FJ897771 | clade_238 | Y | OP |
| *Bacillus* sp. HU33.1 | 240 | FJ897772 | clade_238 | Y | OP |
| *Bacillus* sp. JC6 | 241 | JF824800 | clade_238 | Y | OP |
| *Bacillus* sp. oral taxon F79 | 248 | HM099654 | clade_238 | Y | OP |
| *Bacillus* sp. SRC_DSF1 | 243 | GU797283 | clade_238 | Y | OP |
| *Bacillus* sp. SRC_DSF10 | 242 | GU797292 | clade_238 | Y | OP |
| *Bacillus* sp. SRC_DSF2 | 244 | GU797284 | clade_238 | Y | OP |
| *Bacillus* sp. SRC_DSF6 | 245 | GU797288 | clade_238 | Y | OP |
| *Bacillus* sp. tc09 | 249 | HQ844242 | clade_238 | Y | OP |
| *Bacillus* sp. zh168 | 250 | FJ851424 | clade_238 | Y | OP |
| *Bacillus sphaericus* | 251 | DQ286318 | clade_238 | Y | OP |
| *Bacillus sporothermodurans* | 252 | NR_026010 | clade_238 | Y | OP |

TABLE 1-continued

List of Operational Taxonomic Units (OTU) with taxonomic assignments made to Genus, Species, and Phylogenetic Clade.

| OTU | SEQ ID Number | Public DB Accession | Clade | Spore Former | Pathogen Status |
|---|---|---|---|---|---|
| Bacillus subtilis | 253 | EU627588 | clade_238 | Y | OP |
| Bacillus thermoamylovorans | 254 | NR_029151 | clade_238 | Y | OP |
| Bacillus thuringiensis | 255 | NC_008600 | clade_238 | Y | OP |
| Bacillus weihenstephanensis | 256 | NR_074926 | clade_238 | Y | OP |
| Geobacillus kaustophilus | 933 | NR_074989 | clade_238 | Y | N |
| Geobacillus stearothermophilus | 936 | NR_040794 | clade_238 | Y | N |
| Geobacillus thermodenitrificans | 938 | NR_074976 | clade_238 | Y | N |
| Geobacillus thermoglucosidasius | 939 | NR_043022 | clade_238 | Y | N |
| Lysinibacillus sphaericus | 1193 | NR_074883 | clade_238 | Y | N |
| Clostridiales sp. SS3_4 | 543 | AY305316 | clade_246 | Y | N |
| Clostridium beijerinckii | 557 | NR_074434 | clade_252 | Y | N |
| Clostridium botulinum | 560 | NC_010723 | clade_252 | Y | Category-A |
| Clostridium butyricum | 561 | ABDT01000017 | clade_252 | Y | N |
| Clostridium chauvoei | 568 | EU106372 | clade_252 | Y | N |
| Clostridium favososporum | 582 | X76749 | clade_252 | Y | N |
| Clostridium histolyticum | 592 | HF558362 | clade_252 | Y | N |
| Clostridium isatidis | 597 | NR_026347 | clade_252 | Y | N |
| Clostridium limosum | 602 | FR870444 | clade_252 | Y | N |
| Clostridium sartagoforme | 622 | NR_026490 | clade_252 | Y | N |
| Clostridium septicum | 624 | NR_026020 | clade_252 | Y | N |
| Clostridium sp. 7_2_43FAA | 626 | ACDK01000101 | clade_252 | Y | N |
| Clostridium sporogenes | 645 | ABKW02000003 | clade_252 | Y | N |
| Clostridium tertium | 653 | Y18174 | clade_252 | Y | N |
| Clostridium carnis | 564 | NR_044716 | clade_253 | Y | N |
| Clostridium celatum | 565 | X77844 | clade_253 | Y | N |
| Clostridium disporicum | 579 | NR_026491 | clade_253 | Y | N |
| Clostridium gasigenes | 585 | NR_024945 | clade_253 | Y | N |
| Clostridium quinii | 616 | NR_026149 | clade_253 | Y | N |
| Clostridium hylemonae | 593 | AB023973 | clade_260 | Y | N |
| Clostridium scindens | 623 | AF262238 | clade_260 | Y | N |
| Lachnospiraceae bacterium 5_1_57FAA | 1054 | ACTR01000020 | clade_260 | Y | N |
| Clostridium glycyrrhizinilyticum | 588 | AB233029 | clade_262 | Y | N |
| Clostridium nexile | 607 | X73443 | clade_262 | Y | N |
| Coprococcus comes | 674 | ABVR01000038 | clade_262 | Y | N |
| Lachnospiraceae bacterium 1_1_57FAA | 1048 | ACTM01000065 | clade_262 | Y | N |
| Lachnospiraceae bacterium 1_4_56FAA | 1049 | ACTN01000028 | clade_262 | Y | N |
| Lachnospiraceae bacterium 8_1_57FAA | 1057 | ACWQ01000079 | clade_262 | Y | N |
| Ruminococcus lactaris | 1663 | ABOU02000049 | clade_262 | Y | N |
| Ruminococcus torques | 1670 | AAVP02000002 | clade_262 | Y | N |
| Paenibacillus lautus | 1397 | NR_040882 | clade_270 | Y | N |
| Paenibacillus polymyxa | 1399 | NR_037006 | clade_270 | Y | N |
| Paenibacillus sp. HGF5 | 1402 | AEXS01000095 | clade_270 | Y | N |
| Paenibacillus sp. HGF7 | 1403 | AFDH01000147 | clade_270 | Y | N |
| Eubacterium sp. oral clone JI012 | 868 | AY349379 | clade_298 | Y | N |
| Alicyclobacillus contaminans | 124 | NR_041475 | clade_301 | Y | N |
| Alicyclobacillus herbarius | 126 | NR_024753 | clade_301 | Y | N |
| Alicyclobacillus pomorum | 127 | NR_024801 | clade_301 | Y | N |
| Blautia coccoides | 373 | AB571656 | clade_309 | Y | N |
| Blautia glucerasea | 374 | AB588023 | clade_309 | Y | N |
| Blautia glucerasei | 375 | AB439724 | clade_309 | Y | N |
| Blautia hansenii | 376 | ABYU02000037 | clade_309 | Y | N |
| Blautia luti | 378 | AB691576 | clade_309 | Y | N |
| Blautia producta | 379 | AB600998 | clade_309 | Y | N |
| Blautia schinkii | 380 | NR_026312 | clade_309 | Y | N |
| Blautia sp. M25 | 381 | HM626178 | clade_309 | Y | N |
| Blautia stercoris | 382 | HM626177 | clade_309 | Y | N |
| Blautia wexlerae | 383 | EF036467 | clade_309 | Y | N |
| Bryantella formatexigens | 439 | ACCL02000018 | clade_309 | Y | N |
| Clostridium coccoides | 573 | EF025906 | clade_309 | Y | N |
| Eubacterium cellulosolvens | 839 | AY178842 | clade_309 | Y | N |
| Lachnospiraceae bacterium 6_1_63FAA | 1056 | ACTV01000014 | clade_309 | Y | N |
| Ruminococcus hansenii | 1662 | M59114 | clade_309 | Y | N |
| Ruminococcus obeum | 1664 | AY169419 | clade_309 | Y | N |
| Ruminococcus sp. 5_1_39BFAA | 1666 | ACII01000172 | clade_309 | Y | N |
| Ruminococcus sp. K_1 | 1669 | AB222208 | clade_309 | Y | N |
| Syntrophococcus sucromutans | 1911 | NR_036869 | clade_309 | Y | N |
| Bacillus alcalophilus | 198 | X76436 | clade_327 | Y | N |
| Bacillus clausii | 205 | FN397477 | clade_327 | Y | OP |
| Bacillus gelatini | 210 | NR_025595 | clade_327 | Y | OP |

TABLE 1-continued

List of Operational Taxonomic Units (OTU) with taxonomic assignments made to Genus, Species, and Phylogenetic Clade.

| OTU | SEQ ID Number | Public DB Accession | Clade | Spore Former | Pathogen Status |
|---|---|---|---|---|---|
| *Bacillus halodurans* | 212 | AY144582 | clade_327 | Y | OP |
| *Bacillus* sp. oral taxon F26 | 246 | HM099642 | clade_327 | Y | OP |
| *Clostridium innocuum* | 595 | M23732 | clade_351 | Y | N |
| *Clostridium* sp. HGF2 | 628 | AENW01000022 | clade_351 | Y | N |
| *Clostridium perfringens* | 612 | ABDW01000023 | clade_353 | Y | Category-B |
| *Sarcina ventriculi* | 1687 | NR_026146 | clade_353 | Y | N |
| *Clostridium bartlettii* | 556 | ABEZ02000012 | clade_354 | Y | N |
| *Clostridium bifermentans* | 558 | X73437 | clade_354 | Y | N |
| *Clostridium ghonii* | 586 | AB542933 | clade_354 | Y | N |
| *Clostridium glycolicum* | 587 | FJ384385 | clade_354 | Y | N |
| *Clostridium mayombei* | 605 | FR733682 | clade_354 | Y | N |
| *Clostridium sordellii* | 625 | AB448946 | clade_354 | Y | N |
| *Clostridium* sp. MT4 E | 635 | FJ159523 | clade_354 | Y | N |
| *Eubacterium tenue* | 872 | M59118 | clade_354 | Y | N |
| *Clostridium argentinense* | 553 | NR_029232 | clade_355 | Y | N |
| *Clostridium* sp. JC122 | 630 | CAEV01000127 | clade_355 | Y | N |
| *Clostridium* sp. NMBHI_1 | 636 | JN093130 | clade_355 | Y | N |
| *Clostridium subterminale* | 650 | NR_041795 | clade_355 | Y | N |
| *Clostridium sulfidigenes* | 651 | NR_044161 | clade_355 | Y | N |
| *Dorea formicigenerans* | 773 | AAXA02000006 | clade_360 | Y | N |
| *Dorea longicatena* | 774 | AJ132842 | clade_360 | Y | N |
| Lachnospiraceae bacterium 2_1_46FAA | 1050 | ADLB01000035 | clade_360 | Y | N |
| Lachnospiraceae bacterium 2_1_58FAA | 1051 | ACTO01000052 | clade_360 | Y | N |
| Lachnospiraceae bacterium 4_1_37FAA | 1053 | ADCR01000030 | clade_360 | Y | N |
| Lachnospiraceae bacterium 9_1_43BFAA | 1058 | ACTX01000023 | clade_360 | Y | N |
| *Ruminococcus gnavus* | 1661 | X94967 | clade_360 | Y | N |
| *Ruminococcus* sp. ID8 | 1668 | AY960564 | clade_360 | Y | N |
| *Blautia hydrogenotrophica* | 377 | ACBZ01000217 | clade_368 | Y | N |
| *Lactonifactor longoviformis* | 1147 | DQ100449 | clade_368 | Y | N |
| *Robinsoniella peoriensis* | 1633 | AF445258 | clade_368 | Y | N |
| *Eubacterium infirmum* | 849 | U13039 | clade_384 | Y | N |
| *Eubacterium* sp. WAL 14571 | 864 | FJ687606 | clade_384 | Y | N |
| Erysipelotrichaceae bacterium 5_2_54FAA | 823 | ACZW01000054 | clade_385 | Y | N |
| *Eubacterium biforme* | 835 | ABYT01000002 | clade_385 | Y | N |
| *Eubacterium cylindroides* | 842 | FP929041 | clade_385 | Y | N |
| *Eubacterium dolichum* | 844 | L34682 | clade_385 | Y | N |
| *Eubacterium* sp. 3_1_31 | 861 | ACTL01000045 | clade_385 | Y | N |
| *Eubacterium tortuosum* | 873 | NR_044648 | clade_385 | Y | N |
| *Bulleidia extructa* | 441 | ADFR01000011 | clade_388 | Y | N |
| *Solobacterium moorei* | 1739 | AECQ01000039 | clade_388 | Y | N |
| *Coprococcus catus* | 673 | EU266552 | clade_393 | Y | N |
| Lachnospiraceae bacterium oral taxon F15 | 1064 | HM099641 | clade_393 | Y | N |
| *Clostridium cochlearium* | 574 | NR_044717 | clade_395 | Y | N |
| *Clostridium malenominatum* | 604 | FR749893 | clade_395 | Y | N |
| *Clostridium tetani* | 654 | NC_004557 | clade_395 | Y | N |
| *Acetivibrio ethanolgignens* | 6 | FR749894 | clade_396 | Y | N |
| *Anaerosporobacter mobilis* | 161 | NR_042953 | clade_396 | Y | N |
| *Bacteroides pectinophilus* | 288 | ABVQ01000036 | clade_396 | Y | N |
| *Clostridium aminovalericum* | 551 | NR_029245 | clade_396 | Y | N |
| *Clostridium phytofermentans* | 613 | NR_074652 | clade_396 | Y | N |
| *Eubacterium hallii* | 848 | L34621 | clade_396 | Y | N |
| *Eubacterium xylanophilum* | 875 | L34628 | clade_396 | Y | N |
| *Ruminococcus callidus* | 1658 | NR_029160 | clade_406 | Y | N |
| *Ruminococcus champanellensis* | 1659 | FP929052 | clade_406 | Y | N |
| *Ruminococcus* sp. 18P13 | 1665 | AJ515913 | clade_406 | Y | N |
| *Ruminococcus* sp. 9SE51 | 1667 | FM954974 | clade_406 | Y | N |
| *Anaerostipes caccae* | 162 | ABAX03000023 | clade_408 | Y | N |
| *Anaerostipes* sp. 3_2_56FAA | 163 | ACWB01000002 | clade_408 | Y | N |
| Clostridiales bacterium 1_7_47FAA | 541 | ABQR01000074 | clade_408 | Y | N |
| Clostridiales sp. SM4_1 | 542 | FP929060 | clade_408 | Y | N |
| Clostridiales sp. SSC_2 | 544 | FP929061 | clade_408 | Y | N |
| *Clostridium aerotolerans* | 546 | X76163 | clade_408 | Y | N |
| *Clostridium aldenense* | 547 | NR_043680 | clade_408 | Y | N |
| *Clostridium algidixylanolyticum* | 550 | NR_028726 | clade_408 | Y | N |
| *Clostridium amygdalinum* | 552 | AY353957 | clade_408 | Y | N |
| *Clostridium asparagiforme* | 554 | ACCJ01000522 | clade_408 | Y | N |
| *Clostridium bolteae* | 559 | ABCC02000039 | clade_408 | Y | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| *Clostridium celerecrescens* | 566 | JQ246092 | clade_408 | Y | N |
| *Clostridium citroniae* | 569 | ADLJ01000059 | clade_408 | Y | N |
| *Clostridium clostridiiformes* | 571 | M59089 | clade_408 | Y | N |
| *Clostridium clostridioforme* | 572 | NR_044715 | clade_408 | Y | N |
| *Clostridium hathewayi* | 590 | AY552788 | clade_408 | Y | N |
| *Clostridium indolis* | 594 | AF028351 | clade_408 | Y | N |
| *Clostridium lavalense* | 600 | EF564277 | clade_408 | Y | N |
| *Clostridium saccharolyticum* | 620 | CP002109 | clade_408 | Y | N |
| *Clostridium* sp. M62_1 | 633 | ACFX02000046 | clade_408 | Y | N |
| *Clostridium* sp. SS2_1 | 638 | ABGC03000041 | clade_408 | Y | N |
| *Clostridium sphenoides* | 643 | X73449 | clade_408 | Y | N |
| *Clostridium symbiosum* | 652 | ADLQ01000114 | clade_408 | Y | N |
| *Clostridium xylanolyticum* | 658 | NR_037068 | clade_408 | Y | N |
| *Eubacterium hadrum* | 847 | FR749933 | clade_408 | Y | N |
| Lachnospiraceae bacterium 3_1_57FAA_CT1 | 1052 | ACTP01000124 | clade_408 | Y | N |
| Lachnospiraceae bacterium 5_1_63FAA | 1055 | ACTS01000081 | clade_408 | Y | N |
| Lachnospiraceae bacterium A4 | 1059 | DQ789118 | clade_408 | Y | N |
| Lachnospiraceae bacterium DJF VP30 | 1060 | EU728771 | clade_408 | Y | N |
| Lachnospiraceae genomosp. C1 | 1065 | AY278618 | clade_408 | Y | N |
| *Clostridium difficile* | 578 | NC_013315 | clade_409 | Y | OP |
| *Eubacterium* sp. AS15b | 862 | HQ616364 | clade_428 | Y | N |
| *Eubacterium* sp. OBRC9 | 863 | HQ616354 | clade_428 | Y | N |
| *Eubacterium* sp. oral clone OH3A | 871 | AY947497 | clade_428 | Y | N |
| *Eubacterium yurii* | 876 | AEES01000073 | clade_428 | Y | N |
| *Clostridium acetobutylicum* | 545 | NR_074511 | clade_430 | Y | N |
| *Clostridium algidicarnis* | 549 | NR_041746 | clade_430 | Y | N |
| *Clostridium cadaveris* | 562 | AB542932 | clade_430 | Y | N |
| *Clostridium carboxidivorans* | 563 | FR733710 | clade_430 | Y | N |
| *Clostridium estertheticum* | 580 | NR_042153 | clade_430 | Y | N |
| *Clostridium fallax* | 581 | NR_044714 | clade_430 | Y | N |
| *Clostridium felsineum* | 583 | AF270502 | clade_430 | Y | N |
| *Clostridium frigidicarnis* | 584 | NR_024919 | clade_430 | Y | N |
| *Clostridium kluyveri* | 598 | NR_074165 | clade_430 | Y | N |
| *Clostridium magnum* | 603 | X77835 | clade_430 | Y | N |
| *Clostridium putrefaciens* | 615 | NR_024995 | clade_430 | Y | N |
| *Clostridium* sp. HPB_46 | 629 | AY862516 | clade_430 | Y | N |
| *Clostridium tyrobutyricum* | 656 | NR_044718 | clade_430 | Y | N |
| *Sutterella parvirubra* | 1899 | AB300989 | clade_432 | Y | N |
| *Acetanaerobacterium elongatum* | 4 | NR_042930 | clade_439 | Y | N |
| *Clostridium cellulosi* | 567 | NR_044624 | clade_439 | Y | N |
| *Ethanoligenens harbinense* | 832 | AY675965 | clade_439 | Y | N |
| *Eubacterium rectale* | 856 | FP929042 | clade_444 | Y | N |
| *Eubacterium* sp. oral clone GI038 | 865 | AY349374 | clade_444 | Y | N |
| *Lachnobacterium bovis* | 1045 | GU324407 | clade_444 | Y | N |
| *Roseburia cecicola* | 1634 | GU233441 | clade_444 | Y | N |
| *Roseburia faecalis* | 1635 | AY804149 | clade_444 | Y | N |
| *Roseburia faecis* | 1636 | AY305310 | clade_444 | Y | N |
| *Roseburia hominis* | 1637 | AJ270482 | clade_444 | Y | N |
| *Roseburia intestinalis* | 1638 | FP929050 | clade_444 | Y | N |
| *Roseburia inulinivorans* | 1639 | AJ270473 | clade_444 | Y | N |
| *Brevibacillus brevis* | 410 | NR_041524 | clade_448 | Y | N |
| *Brevibacillus laterosporus* | 414 | NR_037005 | clade_448 | Y | N |
| *Bacillus coagulans* | 206 | DQ297928 | clade_451 | Y | OP |
| *Sporolactobacillus inulinus* | 1752 | NR_040962 | clade_451 | Y | N |
| *Kocuria palustris* | 1041 | EU333884 | clade_453 | Y | N |
| *Nocardia farcinica* | 1353 | NC_006361 | clade_455 | Y | N |
| *Bacillus* sp. oral taxon F28 | 247 | HM099650 | clade_456 | Y | OP |
| *Catenibacterium mitsuokai* | 495 | AB030224 | clade_469 | Y | N |
| *Clostridium* sp. TM_40 | 640 | AB249652 | clade_469 | Y | N |
| *Coprobacillus cateniformis* | 670 | AB030218 | clade_469 | Y | N |
| *Coprobacillus* sp. 29_1 | 671 | ADKX01000057 | clade_469 | Y | N |
| *Clostridium rectum* | 618 | NR_029271 | clade_470 | Y | N |
| *Eubacterium nodatum* | 854 | U13041 | clade_476 | Y | N |
| *Eubacterium saphenum* | 859 | NR_026031 | clade_476 | Y | N |
| *Eubacterium* sp. oral clone JH012 | 867 | AY349373 | clade_476 | Y | N |
| *Eubacterium* sp. oral clone JS001 | 870 | AY349378 | clade_476 | Y | N |
| *Faecalibacterium prausnitzii* | 880 | ACOP02000011 | clade_478 | Y | N |
| *Gemmiger formicilis* | 932 | GU562446 | clade_478 | Y | N |
| *Subdoligranulum variabile* | 1896 | AJ518869 | clade_478 | Y | N |
| Clostridiaceae bacterium JC13 | 532 | JF824807 | clade_479 | Y | N |
| *Clostridium* sp. MLG055 | 634 | AF304435 | clade_479 | Y | N |

TABLE 1-continued

List of Operational Taxonomic Units (OTU) with taxonomic assignments made to Genus, Species, and Phylogenetic Clade.

| OTU | SEQ ID Number | Public DB Accession | Clade | Spore Former | Pathogen Status |
|---|---|---|---|---|---|
| Erysipelotrichaceae bacterium 3_1_53 | 822 | ACTJ01000113 | clade_479 | Y | N |
| Clostridium cocleatum | 575 | NR_026495 | clade_481 | Y | N |
| Clostridium ramosum | 617 | M23731 | clade_481 | Y | N |
| Clostridium saccharogumia | 619 | DQ100445 | clade_481 | Y | N |
| Clostridium spiroforme | 644 | X73441 | clade_481 | Y | N |
| Coprobacillus sp. D7 | 672 | ACDT01000199 | clade_481 | Y | N |
| Clostridiales bacterium SY8519 | 535 | AB477431 | clade_482 | Y | N |
| Clostridium sp. SY8519 | 639 | AP012212 | clade_482 | Y | N |
| Eubacterium ramulus | 855 | AJ011522 | clade_482 | Y | N |
| Erysipelothrix inopinata | 819 | NR_025594 | clade_485 | Y | N |
| Erysipelothrix rhusiopathiae | 820 | ACLK01000021 | clade_485 | Y | N |
| Erysipelothrix tonsillarum | 821 | NR_040871 | clade_485 | Y | N |
| Holdemania filiformis | 1004 | Y11466 | clade_485 | Y | N |
| Mollicutes bacterium pACH93 | 1258 | AY297808 | clade_485 | Y | N |
| Coxiella burnetii | 736 | CP000890 | clade_486 | Y | Category-B |
| Clostridium hiranonis | 591 | AB023970 | clade_487 | Y | N |
| Clostridium irregulare | 596 | NR_029249 | clade_487 | Y | N |
| Clostridium orbiscindens | 609 | Y18187 | clade_494 | Y | N |
| Clostridium sp. NML 04A032 | 637 | EU815224 | clade_494 | Y | N |
| Flavonifractor plautii | 886 | AY724678 | clade_494 | Y | N |
| Pseudoflavonifractor capillosus | 1591 | AY136666 | clade_494 | Y | N |
| Ruminococcaceae bacterium D16 | 1655 | ADDX01000083 | clade_494 | Y | N |
| Acetivibrio cellulolyticus | 5 | NR_025917 | clade_495 | Y | N |
| Clostridium aldrichii | 548 | NR_026099 | clade_495 | Y | N |
| Clostridium clariflavum | 570 | NR_041235 | clade_495 | Y | N |
| Clostridium stercorarium | 647 | NR_025100 | clade_495 | Y | N |
| Clostridium straminisolvens | 649 | NR_024829 | clade_495 | Y | N |
| Clostridium thermocellum | 655 | NR_074629 | clade_495 | Y | N |
| Fusobacterium nucleatum | 901 | ADVK01000034 | clade_497 | Y | N |
| Eubacterium barkeri | 834 | NR_044661 | clade_512 | Y | N |
| Eubacterium callanderi | 838 | NR_026330 | clade_512 | Y | N |
| Eubacterium limosum | 850 | CP002273 | clade_512 | Y | N |
| Anaerotruncus colihominis | 164 | ABGD02000021 | clade_516 | Y | N |
| Clostridium methylpentosum | 606 | ACEC01000059 | clade_516 | Y | N |
| Clostridium sp. YIT 12070 | 642 | AB491208 | clade_516 | Y | N |
| Hydrogenoanaerobacterium saccharovorans | 1005 | NR_044425 | clade_516 | Y | N |
| Ruminococcus albus | 1656 | AY445600 | clade_516 | Y | N |
| Ruminococcus flavefaciens | 1660 | NR_025931 | clade_516 | Y | N |
| Clostridium haemolyticum | 589 | NR_024749 | clade_517 | Y | N |
| Clostridium novyi | 608 | NR_074343 | clade_517 | Y | N |
| Clostridium sp. LMG 16094 | 632 | X95274 | clade_517 | Y | N |
| Eubacterium ventriosum | 874 | L34421 | clade_519 | Y | N |
| Bacteroides galacturonicus | 280 | DQ497994 | clade_522 | Y | N |
| Eubacterium eligens | 845 | CP001104 | clade_522 | Y | N |
| Lachnospira multipara | 1046 | FR733699 | clade_522 | Y | N |
| Lachnospira pectinoschiza | 1047 | L14675 | clade_522 | Y | N |
| Lactobacillus rogosae | 1114 | GU269544 | clade_522 | Y | N |
| Bacillus horti | 214 | NR_036860 | clade_527 | Y | OP |
| Bacillus sp. 9_3AIA | 232 | FN397519 | clade_527 | Y | OP |
| Eubacterium brachy | 836 | U13038 | clade_533 | Y | N |
| Filifactor alocis | 881 | CP002390 | clade_533 | Y | N |
| Filifactor villosus | 882 | NR_041928 | clade_533 | Y | N |
| Clostridium leptum | 601 | AJ305238 | clade_537 | Y | N |
| Clostridium sp. YIT 12069 | 641 | AB491207 | clade_537 | Y | N |
| Clostridium sporosphaeroides | 646 | NR_044835 | clade_537 | Y | N |
| Eubacterium coprostanoligenes | 841 | HM037995 | clade_537 | Y | N |
| Ruminococcus bromii | 1657 | EU266549 | clade_537 | Y | N |
| Eubacterium siraeum | 860 | ABCA03000054 | clade_538 | Y | N |
| Clostridium viride | 657 | NR_026204 | clade_540 | Y | N |
| Oscillibacter sp. G2 | 1386 | HM626173 | clade_540 | Y | N |
| Oscillibacter valericigenes | 1387 | NR_074793 | clade_540 | Y | N |
| Oscillospira guilliermondii | 1388 | AB040495 | clade_540 | Y | N |
| Butyrivibrio crossotus | 455 | ABWN01000012 | clade_543 | Y | N |
| Clostridium sp. L2_50 | 631 | AAYW02000018 | clade_543 | Y | N |
| Coprococcus eutactus | 675 | EF031543 | clade_543 | Y | N |
| Coprococcus sp. ART55_1 | 676 | AY350746 | clade_543 | Y | N |
| Eubacterium ruminantium | 857 | NR_024661 | clade_543 | Y | N |
| Collinsella aerofaciens | 659 | AAVN02000007 | clade_553 | Y | N |
| Alkaliphilus metalliredigenes | 137 | AY137848 | clade_554 | Y | N |
| Alkaliphilus oremlandii | 138 | NR_043674 | clade_554 | Y | N |
| Clostridium sticklandii | 648 | L04167 | clade_554 | Y | N |
| Turicibacter sanguinis | 1965 | AF349724 | clade_555 | Y | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| *Fulvimonas* sp. NML 060897 | 892 | EF589680 | clade_557 | Y | N |
| *Desulfitobacterium frappieri* | 753 | AJ276701 | clade_560 | Y | N |
| *Desulfitobacterium hafniense* | 754 | NR_074996 | clade_560 | Y | N |
| *Desulfotomaculum nigrificans* | 756 | NR_044832 | clade_560 | Y | N |
| *Lutispora thermophila* | 1191 | NR_041236 | clade_564 | Y | N |
| *Brachyspira pilosicoli* | 405 | NR_075069 | clade_565 | Y | N |
| *Eggerthella lenta* | 778 | AF292375 | clade_566 | Y | N |
| *Streptomyces albus* | 1888 | AJ697941 | clade_566 | Y | N |
| Chlamydiales bacterium NS11 | 505 | JN606074 | clade_567 | Y | N |
| *Anaerofustis stercorihominis* | 159 | ABIL02000005 | clade_570 | Y | N |
| *Butyricicoccus pullicaecorum* | 453 | HH793440 | clade_572 | Y | N |
| *Eubacterium desmolans* | 843 | NR_044644 | clade_572 | Y | N |
| *Papillibacter cinnamivorans* | 1415 | NR_025025 | clade_572 | Y | N |
| *Sporobacter termitidis* | 1751 | NR_044972 | clade_572 | Y | N |
| Deferribacteres sp. oral clone JV006 | 744 | AY349371 | clade_575 | Y | N |
| *Clostridium colinum* | 577 | NR_026151 | clade_576 | Y | N |
| *Clostridium lactatifermentans* | 599 | NR_025651 | clade_576 | Y | N |
| *Clostridium piliforme* | 614 | D14639 | clade_576 | Y | N |
| *Saccharomonospora viridis* | 1671 | X54286 | clade_579 | Y | N |
| *Thermobifida fusca* | 1921 | NC_007333 | clade_579 | Y | N |
| *Leptospira licerasiae* | 1164 | EF612284 | clade_585 | Y | OP |
| *Moorella thermoacetica* | 1259 | NR_075001 | clade_590 | Y | N |
| *Thermoanaerobacter pseudethanolicus* | 1920 | CP000924 | clade_590 | Y | N |
| *Flexistipes sinusarabici* | 888 | NR_074881 | clade_591 | Y | N |
| *Gloeobacter violaceus* | 942 | NR_074282 | clade_596 | Y | N |
| *Eubacterium* sp. oral clone JN088 | 869 | AY349377 | clade_90 | Y | N |
| *Clostridium oroticum* | 610 | FR749922 | clade_96 | Y | N |
| *Clostridium* sp. D5 | 627 | ADBG01000142 | clade_96 | Y | N |
| *Eubacterium contortum* | 840 | FR749946 | clade_96 | Y | N |
| *Eubacterium fissicatena* | 846 | FR749935 | clade_96 | Y | N |
| *Corynebacterium coyleae* | 692 | X96497 | clade_100 | N | N |
| *Corynebacterium mucifaciens* | 711 | NR_026396 | clade_100 | N | N |
| *Corynebacterium ureicelerivorans* | 733 | AM397636 | clade_100 | N | N |
| *Corynebacterium appendicis* | 684 | NR_028951 | clade_102 | N | N |
| *Corynebacterium genitalium* | 698 | ACLJ01000031 | clade_102 | N | N |
| *Corynebacterium glaucum* | 699 | NR_028971 | clade_102 | N | N |
| *Corynebacterium imitans* | 703 | AF537597 | clade_102 | N | N |
| *Corynebacterium riegelii* | 719 | EU848548 | clade_102 | N | N |
| *Corynebacterium* sp. L_2012475 | 723 | HE575405 | clade_102 | N | N |
| *Corynebacterium* sp. NML 93_0481 | 724 | GU238409 | clade_102 | N | N |
| *Corynebacterium sundsvallense* | 728 | Y09655 | clade_102 | N | N |
| *Corynebacterium tuscaniae* | 730 | AY677186 | clade_102 | N | N |
| *Prevotella maculosa* | 1504 | AGEK01000035 | clade_104 | N | N |
| *Prevotella oris* | 1513 | ADDV01000091 | clade_104 | N | N |
| *Prevotella salivae* | 1517 | AB108826 | clade_104 | N | N |
| *Prevotella* sp. ICM55 | 1521 | HQ616399 | clade_104 | N | N |
| *Prevotella* sp. oral clone AA020 | 1528 | AY005057 | clade_104 | N | N |
| *Prevotella* sp. oral clone GI032 | 1538 | AY349396 | clade_104 | N | N |
| *Prevotella* sp. oral taxon G70 | 1558 | GU432179 | clade_104 | N | N |
| *Prevotella corporis* | 1491 | L16465 | clade_105 | N | N |
| *Bacteroides* sp. 4_1_36 | 312 | ACTC01000133 | clade_110 | N | N |
| *Bacteroides* sp. AR20 | 315 | AF139524 | clade_110 | N | N |
| *Bacteroides* sp. D20 | 319 | ACPT01000052 | clade_110 | N | N |
| *Bacteroides* sp. F_4 | 322 | AB470322 | clade_110 | N | N |
| *Bacteroides uniformis* | 329 | AB050110 | clade_110 | N | N |
| *Prevotella nanceiensis* | 1510 | JN867228 | clade_127 | N | N |
| *Prevotella* sp. oral taxon 299 | 1548 | ACWZ01000026 | clade_127 | N | N |
| *Prevotella bergensis* | 1485 | ACKS01000100 | clade_128 | N | N |
| *Prevotella buccalis* | 1489 | JN867261 | clade_129 | N | N |
| *Prevotella timonensis* | 1564 | ADEF01000012 | clade_129 | N | N |
| *Prevotella oralis* | 1512 | AEPE01000021 | clade_130 | N | N |
| *Prevotella* sp. SEQ072 | 1525 | JN867238 | clade_130 | N | N |
| *Leuconostoc carnosum* | 1177 | NR_040811 | clade_135 | N | N |
| *Leuconostoc gasicomitatum* | 1179 | FN822744 | clade_135 | N | N |
| *Leuconostoc inhae* | 1180 | NR_025204 | clade_135 | N | N |
| *Leuconostoc kimchii* | 1181 | NR_075014 | clade_135 | N | N |
| *Edwardsiella tarda* | 777 | CP002154 | clade_139 | N | N |
| *Photorhabdus asymbiotica* | 1466 | Z76752 | clade_139 | N | N |
| *Psychrobacter arcticus* | 1607 | CP000082 | clade_141 | N | N |
| *Psychrobacter cibarius* | 1608 | HQ698586 | clade_141 | N | N |
| *Psychrobacter cryohalolentis* | 1609 | CP000323 | clade_141 | N | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| *Psychrobacter faecalis* | 1610 | HQ698566 | clade_141 | N | N |
| *Psychrobacter nivimaris* | 1611 | HQ698587 | clade_141 | N | N |
| *Psychrobacter pulmonis* | 1612 | HQ698582 | clade_141 | N | N |
| *Pseudomonas aeruginosa* | 1592 | AABQ07000001 | clade_154 | N | N |
| *Pseudomonas* sp. 2_1_26 | 1600 | ACWU01000257 | clade_154 | N | N |
| *Corynebacterium confusum* | 691 | Y15886 | clade_158 | N | N |
| *Corynebacterium propinquum* | 712 | NR_037038 | clade_158 | N | N |
| *Corynebacterium pseudodiphtheriticum* | 713 | X84258 | clade_158 | N | N |
| *Bartonella bacilliformis* | 338 | NC_008783 | clade_159 | N | N |
| *Bartonella grahamii* | 339 | CP001562 | clade_159 | N | N |
| *Bartonella henselae* | 340 | NC_005956 | clade_159 | N | N |
| *Bartonella quintana* | 341 | BX897700 | clade_159 | N | N |
| *Bartonella tamiae* | 342 | EF672728 | clade_159 | N | N |
| *Bartonella washoensis* | 343 | FJ719017 | clade_159 | N | N |
| *Brucella abortus* | 430 | ACBJ01000075 | clade_159 | N | Category-B |
| *Brucella canis* | 431 | NR_044652 | clade_159 | N | Category-B |
| *Brucella ceti* | 432 | ACJD01000006 | clade_159 | N | Category-B |
| *Brucella melitensis* | 433 | AE009462 | clade_159 | N | Category-B |
| *Brucella microti* | 434 | NR_042549 | clade_159 | N | Category-B |
| *Brucella ovis* | 435 | NC_009504 | clade_159 | N | Category-B |
| *Brucella* sp. 83_13 | 436 | ACBQ01000040 | clade_159 | N | Category-B |
| *Brucella* sp. BO1 | 437 | EU053207 | clade_159 | N | Category-B |
| *Brucella suis* | 438 | ACBK01000034 | clade_159 | N | Category-B |
| *Ochrobactrum anthropi* | 1360 | NC_009667 | clade_159 | N | N |
| *Ochrobactrum intermedium* | 1361 | ACQA01000001 | clade_159 | N | N |
| *Ochrobactrum pseudintermedium* | 1362 | DQ365921 | clade_159 | N | N |
| *Prevotella* genomosp. C2 | 1496 | AY278625 | clade_164 | N | N |
| *Prevotella multisaccharivorax* | 1509 | AFJE01000016 | clade_164 | N | N |
| *Prevotella* sp. oral clone IDR_CEC_0055 | 1543 | AY550997 | clade_164 | N | N |
| *Prevotella* sp. oral taxon 292 | 1547 | GQ422735 | clade_164 | N | N |
| *Prevotella* sp. oral taxon 300 | 1549 | GU409549 | clade_164 | N | N |
| *Prevotella marshii* | 1505 | AEEI01000070 | clade_166 | N | N |
| *Prevotella* sp. oral clone IK053 | 1544 | AY349401 | clade_166 | N | N |
| *Prevotella* sp. oral taxon 781 | 1554 | GQ422744 | clade_166 | N | N |
| *Prevotella stercorea* | 1562 | AB244774 | clade_166 | N | N |
| *Prevotella brevis* | 1487 | NR_041954 | clade_167 | N | N |
| *Prevotella ruminicola* | 1516 | CP002006 | clade_167 | N | N |
| *Prevotella* sp. sp24 | 1560 | AB003384 | clade_167 | N | N |
| *Prevotella* sp. sp34 | 1561 | AB003385 | clade_167 | N | N |
| *Prevotella albensis* | 1483 | NR_025300 | clade_168 | N | N |
| *Prevotella copri* | 1490 | ACBX02000014 | clade_168 | N | N |
| *Prevotella oulorum* | 1514 | L16472 | clade_168 | N | N |
| *Prevotella* sp. BI_42 | 1518 | AJ581354 | clade_168 | N | N |
| *Prevotella* sp. oral clone P4PB_83 P2 | 1546 | AY207050 | clade_168 | N | N |
| *Prevotella* sp. oral taxon G60 | 1557 | GU432133 | clade_168 | N | N |
| *Prevotella amnii* | 1484 | AB547670 | clade_169 | N | N |
| *Bacteroides caccae* | 268 | EU136686 | clade_170 | N | N |
| *Bacteroides finegoldii* | 277 | AB222699 | clade_170 | N | N |
| *Bacteroides intestinalis* | 283 | ABJL02000006 | clade_171 | N | N |
| *Bacteroides* sp. XB44A | 326 | AM230649 | clade_171 | N | N |
| Bifidobacteriaceae genomosp. C1 | 345 | AY278612 | clade_172 | N | N |
| *Bifidobacterium adolescentis* | 346 | AAXD02000018 | clade_172 | N | N |
| *Bifidobacterium angulatum* | 347 | ABYS02000004 | clade_172 | N | N |
| *Bifidobacterium animalis* | 348 | CP001606 | clade_172 | N | N |
| *Bifidobacterium breve* | 350 | CP002743 | clade_172 | N | N |
| *Bifidobacterium catenulatum* | 351 | ABXY01000019 | clade_172 | N | N |
| *Bifidobacterium dentium* | 352 | CP001750 | clade_172 | N | OP |
| *Bifidobacterium gallicum* | 353 | ABXB03000004 | clade_172 | N | N |
| *Bifidobacterium infantis* | 354 | AY151398 | clade_172 | N | N |
| *Bifidobacterium kashiwanohense* | 355 | AB491757 | clade_172 | N | N |
| *Bifidobacterium longum* | 356 | ABQQ01000041 | clade_172 | N | N |
| *Bifidobacterium pseudocatenulatum* | 357 | ABXX02000002 | clade_172 | N | N |
| *Bifidobacterium pseudolongum* | 358 | NR_043442 | clade_172 | N | N |
| *Bifidobacterium scardovii* | 359 | AJ307005 | clade_172 | N | N |
| *Bifidobacterium* sp. HM2 | 360 | AB425276 | clade_172 | N | N |
| *Bifidobacterium* sp. HMLN12 | 361 | JF519685 | clade_172 | N | N |
| *Bifidobacterium* sp. M45 | 362 | HM626176 | clade_172 | N | N |
| *Bifidobacterium* sp. MSX5B | 363 | HQ616382 | clade_172 | N | N |
| *Bifidobacterium* sp. TM_7 | 364 | AB218972 | clade_172 | N | N |
| *Bifidobacterium thermophilum* | 365 | DQ340557 | clade_172 | N | N |

TABLE 1-continued

List of Operational Taxonomic Units (OTU) with taxonomic assignments made to Genus, Species, and Phylogenetic Clade.

| OTU | SEQ ID Number | Public DB Accession | Clade | Spore Former | Pathogen Status |
|---|---|---|---|---|---|
| *Leuconostoc citreum* | 1178 | AM157444 | clade_175 | N | N |
| *Leuconostoc lactis* | 1182 | NR_040823 | clade_175 | N | N |
| *Alicyclobacillus acidoterrestris* | 123 | NR_040844 | clade_179 | N | N |
| *Alicyclobacillus cycloheptanicus* | 125 | NR_024754 | clade_179 | N | N |
| *Acinetobacter baumannii* | 27 | ACYQ01000014 | clade_181 | N | N |
| *Acinetobacter calcoaceticus* | 28 | AM157426 | clade_181 | N | N |
| *Acinetobacter* genomosp. C1 | 29 | AY278636 | clade_181 | N | N |
| *Acinetobacter haemolyticus* | 30 | ADMT01000017 | clade_181 | N | N |
| *Acinetobacter johnsonii* | 31 | ACPL01000162 | clade_181 | N | N |
| *Acinetobacter junii* | 32 | ACPM01000135 | clade_181 | N | N |
| *Acinetobacter lwoffii* | 33 | ACPN01000204 | clade_181 | N | N |
| *Acinetobacter parvus* | 34 | AIEB01000124 | clade_181 | N | N |
| *Acinetobacter schindleri* | 36 | NR_025412 | clade_181 | N | N |
| *Acinetobacter* sp. 56A1 | 37 | GQ178049 | clade_181 | N | N |
| *Acinetobacter* sp. CIP 101934 | 38 | JQ638573 | clade_181 | N | N |
| *Acinetobacter* sp. CIP 102143 | 39 | JQ638578 | clade_181 | N | N |
| *Acinetobacter* sp. M16_22 | 41 | HM366447 | clade_181 | N | N |
| *Acinetobacter* sp. RUH2624 | 42 | ACQF01000094 | clade_181 | N | N |
| *Acinetobacter* sp. SH024 | 43 | ADCH01000068 | clade_181 | N | N |
| *Lactobacillus jensenii* | 1092 | ACQD01000066 | clade_182 | N | N |
| *Alcaligenes faecalis* | 119 | AB680368 | clade_183 | N | N |
| *Alcaligenes* sp. CO14 | 120 | DQ643040 | clade_183 | N | N |
| *Alcaligenes* sp. S3 | 121 | HQ262549 | clade_183 | N | N |
| *Oligella ureolytica* | 1366 | NR_041998 | clade_183 | N | N |
| *Oligella urethralis* | 1367 | NR_041753 | clade_183 | N | N |
| *Eikenella corrodens* | 784 | ACEA01000028 | clade_185 | N | N |
| *Kingella denitrificans* | 1019 | AEWV01000047 | clade_185 | N | N |
| *Kingella* genomosp. P1 oral cone MB2_C20 | 1020 | DQ003616 | clade_185 | N | N |
| *Kingella kingae* | 1021 | AFHS01000073 | clade_185 | N | N |
| *Kingella oralis* | 1022 | ACJW02000005 | clade_185 | N | N |
| *Kingella* sp. oral clone ID059 | 1023 | AY349381 | clade_185 | N | N |
| *Neisseria elongata* | 1330 | ADBF01000003 | clade_185 | N | N |
| *Neisseria* genomosp. P2 oral clone MB5_P15 | 1332 | DQ003630 | clade_185 | N | N |
| *Neisseria* sp. oral clone JC012 | 1345 | AY349388 | clade_185 | N | N |
| *Neisseria* sp. SMC_A9199 | 1342 | FJ763637 | clade_185 | N | N |
| *Simonsiella muelleri* | 1731 | ADCY01000105 | clade_185 | N | N |
| *Corynebacterium glucuronolyticum* | 700 | ABYP01000081 | clade_193 | N | N |
| *Corynebacterium pyruviciproducens* | 716 | FJ185225 | clade_193 | N | N |
| *Rothia aeria* | 1649 | DQ673320 | clade_194 | N | N |
| *Rothia dentocariosa* | 1650 | ADDW01000024 | clade_194 | N | N |
| *Rothia* sp. oral taxon 188 | 1653 | GU470892 | clade_194 | N | N |
| *Corynebacterium accolens* | 681 | ACGD01000048 | clade_195 | N | N |
| *Corynebacterium macginleyi* | 707 | AB359393 | clade_195 | N | N |
| *Corynebacterium pseudogenitalium* | 714 | ABYQ01000237 | clade_195 | N | N |
| *Corynebacterium tuberculostearicum* | 729 | ACVP01000009 | clade_195 | N | N |
| *Lactobacillus casei* | 1074 | CP000423 | clade_198 | N | N |
| *Lactobacillus paracasei* | 1106 | ABQV01000067 | clade_198 | N | N |
| *Lactobacillus zeae* | 1143 | NR_037122 | clade_198 | N | N |
| *Prevotella dentalis* | 1492 | AB547678 | clade_205 | N | N |
| *Prevotella* sp. oral clone ASCG10 | 1529 | AY923148 | clade_206 | N | N |
| *Prevotella* sp. oral clone HF050 | 1541 | AY349399 | clade_206 | N | N |
| *Prevotella* sp. oral clone ID019 | 1542 | AY349400 | clade_206 | N | N |
| *Prevotella* sp. oral clone IK062 | 1545 | AY349402 | clade_206 | N | N |
| *Prevotella* genomosp. P9 oral clone MB7_G16 | 1499 | DQ003633 | clade_207 | N | N |
| *Prevotella* sp. oral clone AU069 | 1531 | AY005062 | clade_207 | N | N |
| *Prevotella* sp. oral clone CY006 | 1532 | AY005063 | clade_207 | N | N |
| *Prevotella* sp. oral clone FL019 | 1534 | AY349392 | clade_207 | N | N |
| *Actinomyces* genomosp. C1 | 56 | AY278610 | clade_212 | N | N |
| *Actinomyces* genomosp. C2 | 57 | AY278611 | clade_212 | N | N |
| *Actinomyces* genomosp. P1 oral clone MB6_C03 | 58 | DQ003632 | clade_212 | N | N |
| *Actinomyces georgiae* | 59 | GU561319 | clade_212 | N | N |
| *Actinomyces israelii* | 60 | AF479270 | clade_212 | N | N |
| *Actinomyces massiliensis* | 61 | AB545934 | clade_212 | N | N |
| *Actinomyces meyeri* | 62 | GU561321 | clade_212 | N | N |
| *Actinomyces odontolyticus* | 66 | ACYT01000123 | clade_212 | N | N |
| *Actinomyces orihominis* | 68 | AJ575186 | clade_212 | N | N |
| *Actinomyces* sp. CCUG 37290 | 71 | AJ234058 | clade_212 | N | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| *Actinomyces* sp. ICM34 | 75 | HQ616391 | clade_212 | N | N |
| *Actinomyces* sp. ICM41 | 76 | HQ616392 | clade_212 | N | N |
| *Actinomyces* sp. ICM47 | 77 | HQ616395 | clade_212 | N | N |
| *Actinomyces* sp. ICM54 | 78 | HQ616398 | clade_212 | N | N |
| *Actinomyces* sp. oral clone IP081 | 87 | AY349366 | clade_212 | N | N |
| *Actinomyces* sp. oral taxon 178 | 91 | AEUH01000060 | clade_212 | N | N |
| *Actinomyces* sp. oral taxon 180 | 92 | AEPP01000041 | clade_212 | N | N |
| *Actinomyces* sp. TeJ5 | 80 | GU561315 | clade_212 | N | N |
| *Haematobacter* sp. BC14248 | 968 | GU396991 | clade_213 | N | N |
| *Paracoccus denitrificans* | 1424 | CP000490 | clade_213 | N | N |
| *Paracoccus marcusii* | 1425 | NR_044922 | clade_213 | N | N |
| *Grimontia hollisae* | 967 | ADAQ01000013 | clade_216 | N | N |
| *Shewanella putrefaciens* | 1723 | CP002457 | clade_216 | N | N |
| *Afipia* genomosp. 4 | 111 | EU117385 | clade_217 | N | N |
| *Rhodopseudomonas palustris* | 1626 | CP000301 | clade_217 | N | N |
| *Methylobacterium extorquens* | 1223 | NC_010172 | clade_218 | N | N |
| *Methylobacterium podarium* | 1224 | AY468363 | clade_218 | N | N |
| *Methylobacterium radiotolerans* | 1225 | GU294320 | clade_218 | N | N |
| *Methylobacterium* sp. 1sub | 1226 | AY468371 | clade_218 | N | N |
| *Methylobacterium* sp. MM4 | 1227 | AY468370 | clade_218 | N | N |
| *Achromobacter denitrificans* | 18 | NR_042021 | clade_224 | N | N |
| *Achromobacter piechaudii* | 19 | ADMS01000149 | clade_224 | N | N |
| *Achromobacter xylosoxidans* | 20 | ACRC01000072 | clade_224 | N | N |
| *Bordetella bronchiseptica* | 384 | NR_025949 | clade_224 | N | OP |
| *Bordetella holmesii* | 385 | AB683187 | clade_224 | N | OP |
| *Bordetella parapertussis* | 386 | NR_025950 | clade_224 | N | OP |
| *Bordetella pertussis* | 387 | BX640418 | clade_224 | N | OP |
| *Microbacterium chocolatum* | 1230 | NR_037045 | clade_225 | N | N |
| *Microbacterium flavescens* | 1231 | EU714363 | clade_225 | N | N |
| *Microbacterium lacticum* | 1233 | EU714351 | clade_225 | N | N |
| *Microbacterium oleivorans* | 1234 | EU714381 | clade_225 | N | N |
| *Microbacterium oxydans* | 1235 | EU714348 | clade_225 | N | N |
| *Microbacterium paraoxydans* | 1236 | AJ491806 | clade_225 | N | N |
| *Microbacterium phyllosphaerae* | 1237 | EU714359 | clade_225 | N | N |
| *Microbacterium schleiferi* | 1238 | NR_044936 | clade_225 | N | N |
| *Microbacterium* sp. 768 | 1239 | EU714378 | clade_225 | N | N |
| *Microbacterium* sp. oral strain C24KA | 1240 | AF287752 | clade_225 | N | N |
| *Microbacterium testaceum* | 1241 | EU714365 | clade_225 | N | N |
| *Corynebacterium atypicum* | 686 | NR_025540 | clade_229 | N | N |
| *Corynebacterium mastitidis* | 708 | AB359395 | clade_229 | N | N |
| *Corynebacterium* sp. NML 97_0186 | 725 | GU238411 | clade_229 | N | N |
| *Mycobacterium elephantis* | 1275 | AF385898 | clade_237 | N | OP |
| *Mycobacterium paraterrae* | 1288 | EU919229 | clade_237 | N | OP |
| *Mycobacterium phlei* | 1289 | GU142920 | clade_237 | N | OP |
| *Mycobacterium* sp. 1776 | 1293 | EU703152 | clade_237 | N | N |
| *Mycobacterium* sp. 1781 | 1294 | EU703147 | clade_237 | N | N |
| *Mycobacterium* sp. AQ1GA4 | 1297 | HM210417 | clade_237 | N | N |
| *Mycobacterium* sp. GN_10546 | 1299 | FJ497243 | clade_237 | N | N |
| *Mycobacterium* sp. GN_10827 | 1300 | FJ497247 | clade_237 | N | N |
| *Mycobacterium* sp. GN_11124 | 1301 | FJ652846 | clade_237 | N | N |
| *Mycobacterium* sp. GN_9188 | 1302 | FJ497240 | clade_237 | N | N |
| *Mycobacterium* sp. GR_2007_210 | 1303 | FJ555538 | clade_237 | N | N |
| *Anoxybacillus contaminans* | 172 | NR_029006 | clade_238 | N | N |
| *Bacillus aeolius* | 195 | NR_025557 | clade_238 | N | N |
| *Brevibacterium frigoritolerans* | 422 | NR_042639 | clade_238 | N | N |
| *Geobacillus* sp. E263 | 934 | DQ647387 | clade_238 | N | N |
| *Geobacillus* sp. WCH70 | 935 | CP001638 | clade_238 | N | N |
| *Geobacillus thermocatenulatus* | 937 | NR_043020 | clade_238 | N | N |
| *Geobacillus thermoleovorans* | 940 | NR_074931 | clade_238 | N | N |
| *Lysinibacillus fusiformis* | 1192 | FN397522 | clade_238 | N | N |
| *Planomicrobium koreense* | 1468 | NR_025011 | clade_238 | N | N |
| *Sporosarcina newyorkensis* | 1754 | AFPZ01000142 | clade_238 | N | N |
| *Sporosarcina* sp. 2681 | 1755 | GU994081 | clade_238 | N | N |
| *Ureibacillus composti* | 1968 | NR_043746 | clade_238 | N | N |
| *Ureibacillus suwonensis* | 1969 | NR_043232 | clade_238 | N | N |
| *Ureibacillus terrenus* | 1970 | NR_025394 | clade_238 | N | N |
| *Ureibacillus thermophilus* | 1971 | NR_043747 | clade_238 | N | N |
| *Ureibacillus thermosphaericus* | 1972 | NR_040961 | clade_238 | N | N |
| *Prevotella micans* | 1507 | AGWK01000061 | clade_239 | N | N |
| *Prevotella* sp. oral clone DA058 | 1533 | AY005065 | clade_239 | N | N |
| *Prevotella* sp. SEQ053 | 1523 | JN867222 | clade_239 | N | N |
| *Treponema socranskii* | 1937 | NR_024868 | clade_240 | N | OP |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| *Treponema* sp. 6:H:D15A_4 | 1938 | AY005083 | clade_240 | N | N |
| *Treponema* sp. oral taxon 265 | 1953 | GU408850 | clade_240 | N | N |
| *Treponema* sp. oral taxon G85 | 1958 | GU432215 | clade_240 | N | N |
| *Porphyromonas endodontalis* | 1472 | ACNN01000021 | clade_241 | N | N |
| *Porphyromonas* sp. oral clone BB134 | 1478 | AY005068 | clade_241 | N | N |
| *Porphyromonas* sp. oral clone F016 | 1479 | AY005069 | clade_241 | N | N |
| *Porphyromonas* sp. oral clone P2PB_52_P1 | 1480 | AY207054 | clade_241 | N | N |
| *Porphyromonas* sp. oral clone P4GB_100 P2 | 1481 | AY207057 | clade_241 | N | N |
| *Acidovorax* sp. 98_63833 | 26 | AY258065 | clade_245 | N | N |
| Comamonadaceae bacterium NML000135 | 663 | JN585335 | clade_245 | N | N |
| Comamonadaceae bacterium NML790751 | 664 | JN585331 | clade_245 | N | N |
| Comamonadaceae bacterium NML910035 | 665 | JN585332 | clade_245 | N | N |
| Comamonadaceae bacterium NML910036 | 666 | JN585333 | clade_245 | N | N |
| *Comamonas* sp. NSP5 | 668 | AB076850 | clade_245 | N | N |
| *Delftia acidovorans* | 748 | CP000884 | clade_245 | N | N |
| *Xenophilus aerolatus* | 2018 | JN585329 | clade_245 | N | N |
| *Oribacterium* sp. oral taxon 078 | 1380 | ACIQ02000009 | clade_246 | N | N |
| *Oribacterium* sp. oral taxon 102 | 1381 | GQ422713 | clade_246 | N | N |
| *Weissella cibaria* | 2007 | NR_036924 | clade_247 | N | N |
| *Weissella confusa* | 2008 | NR_040816 | clade_247 | N | N |
| *Weissella hellenica* | 2009 | AB680902 | clade_247 | N | N |
| *Weissella kandleri* | 2010 | NR_044659 | clade_247 | N | N |
| *Weissella koreensis* | 2011 | NR_075058 | clade_247 | N | N |
| *Weissella paramesenteroides* | 2012 | ACKU01000017 | clade_247 | N | N |
| *Weissella* sp. KLDS 7.0701 | 2013 | EU600924 | clade_247 | N | N |
| *Mobiluncus curtisii* | 1251 | AEPZ01000013 | clade_249 | N | N |
| *Enhydrobacter aerosaccus* | 785 | ACYI01000081 | clade_256 | N | N |
| *Moraxella osloensis* | 1262 | JN175341 | clade_256 | N | N |
| *Moraxella* sp. GM2 | 1264 | JF837191 | clade_256 | N | N |
| *Brevibacterium casei* | 420 | JF951998 | clade_257 | N | N |
| *Brevibacterium epidermidis* | 421 | NR_029262 | clade_257 | N | N |
| *Brevibacterium sanguinis* | 426 | NR_028016 | clade_257 | N | N |
| *Brevibacterium* sp. H15 | 427 | AB177640 | clade_257 | N | N |
| *Acinetobacter radioresistens* | 35 | ACVR01000010 | clade_261 | N | N |
| *Lactobacillus alimentarius* | 1068 | NR_044701 | clade_263 | N | N |
| *Lactobacillus farciminis* | 1082 | NR_044707 | clade_263 | N | N |
| *Lactobacillus kimchii* | 1097 | NR_025045 | clade_263 | N | N |
| *Lactobacillus nodensis* | 1101 | NR_041629 | clade_263 | N | N |
| *Lactobacillus tucceti* | 1138 | NR_042194 | clade_263 | N | N |
| *Pseudomonas mendocina* | 1595 | AAUL01000021 | clade_265 | N | N |
| *Pseudomonas pseudoalcaligenes* | 1598 | NR_037000 | clade_265 | N | N |
| *Pseudomonas* sp. NP522b | 1602 | EU723211 | clade_265 | N | N |
| *Pseudomonas stutzeri* | 1603 | AM905854 | clade_265 | N | N |
| *Paenibacillus barcinonensis* | 1390 | NR_042272 | clade_270 | N | N |
| *Paenibacillus barengoltzii* | 1391 | NR_042756 | clade_270 | N | N |
| *Paenibacillus chibensis* | 1392 | NR_040885 | clade_270 | N | N |
| *Paenibacillus cookii* | 1393 | NR_025372 | clade_270 | N | N |
| *Paenibacillus durus* | 1394 | NR_037017 | clade_270 | N | N |
| *Paenibacillus glucanolyticus* | 1395 | D78470 | clade_270 | N | N |
| *Paenibacillus lactis* | 1396 | NR_025739 | clade_270 | N | N |
| *Paenibacillus pabuli* | 1398 | NR_040853 | clade_270 | N | N |
| *Paenibacillus popilliae* | 1400 | NR_040888 | clade_270 | N | N |
| *Paenibacillus* sp. CIP 101062 | 1401 | HM212646 | clade_270 | N | N |
| *Paenibacillus* sp. JC66 | 1404 | JF824808 | clade_270 | N | N |
| *Paenibacillus* sp. R_27413 | 1405 | HE586333 | clade_270 | N | N |
| *Paenibacillus* sp. R_27422 | 1406 | HE586338 | clade_270 | N | N |
| *Paenibacillus timonensis* | 1408 | NR_042844 | clade_270 | N | N |
| *Rothia mucilaginosa* | 1651 | ACVO01000020 | clade_271 | N | N |
| *Rothia nasimurium* | 1652 | NR_025310 | clade_271 | N | N |
| *Prevotella* sp. oral taxon 302 | 1550 | ACZK01000043 | clade_280 | N | N |
| *Prevotella* sp. oral taxon F68 | 1556 | HM099652 | clade_280 | N | N |
| *Prevotella tannerae* | 1563 | ACIJ02000018 | clade_280 | N | N |
| Prevotellaceae bacterium P4P_62 P1 | 1566 | AY207061 | clade_280 | N | N |
| *Porphyromonas asaccharolytica* | 1471 | AENO01000048 | clade_281 | N | N |
| *Porphyromonas gingivalis* | 1473 | AE015924 | clade_281 | N | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| *Porphyromonas macacae* | 1475 | NR_025908 | clade_281 | N | N |
| *Porphyromonas* sp. UQD 301 | 1477 | EU012301 | clade_281 | N | N |
| *Porphyromonas uenonis* | 1482 | ACLR01000152 | clade_281 | N | N |
| *Leptotrichia buccalis* | 1165 | CP001685 | clade_282 | N | N |
| *Leptotrichia hofstadii* | 1168 | ACVB02000032 | clade_282 | N | N |
| *Leptotrichia* sp. oral clone HE012 | 1173 | AY349386 | clade_282 | N | N |
| *Leptotrichia* sp. oral taxon 223 | 1176 | GU408547 | clade_282 | N | N |
| *Bacteroides fluxus* | 278 | AFBN01000029 | clade_285 | N | N |
| *Bacteroides helcogenes* | 281 | CP002352 | clade_285 | N | N |
| *Parabacteroides johnsonii* | 1419 | ABYH01000014 | clade_286 | N | N |
| *Parabacteroides merdae* | 1420 | EU136685 | clade_286 | N | N |
| *Treponema denticola* | 1926 | ADEC01000002 | clade_288 | N | OP |
| *Treponema* genomosp. P5 oral clone MB3_P23 | 1929 | DQ003624 | clade_288 | N | N |
| *Treponema putidum* | 1935 | AJ543428 | clade_288 | N | OP |
| *Treponema* sp. oral clone P2PB_53 P3 | 1942 | AY207055 | clade_288 | N | N |
| *Treponema* sp. oral taxon 247 | 1949 | GU408748 | clade_288 | N | N |
| *Treponema* sp. oral taxon 250 | 1950 | GU408776 | clade_288 | N | N |
| *Treponema* sp. oral taxon 251 | 1951 | GU408781 | clade_288 | N | N |
| *Anaerococcus hydrogenalis* | 144 | ABXA01000039 | clade_289 | N | N |
| *Anaerococcus* sp. 8404299 | 148 | HM587318 | clade_289 | N | N |
| *Anaerococcus* sp. gpac215 | 156 | AM176540 | clade_289 | N | N |
| *Anaerococcus vaginalis* | 158 | ACXU01000016 | clade_289 | N | N |
| *Propionibacterium acidipropionici* | 1569 | NC_019395 | clade_290 | N | N |
| *Propionibacterium avidum* | 1571 | AJ003055 | clade_290 | N | N |
| *Propionibacterium granulosum* | 1573 | FJ785716 | clade_290 | N | N |
| *Propionibacterium jensenii* | 1574 | NR_042269 | clade_290 | N | N |
| *Propionibacterium propionicum* | 1575 | NR_025277 | clade_290 | N | N |
| *Propionibacterium* sp. H456 | 1577 | AB177643 | clade_290 | N | N |
| *Propionibacterium thoenii* | 1581 | NR_042270 | clade_290 | N | N |
| *Bifidobacterium bifidum* | 349 | ABQP01000027 | clade_293 | N | N |
| *Leuconostoc mesenteroides* | 1183 | ACKV01000113 | clade_295 | N | N |
| *Leuconostoc pseudomesenteroides* | 1184 | NR_040814 | clade_295 | N | N |
| *Johnsonella ignava* | 1016 | X87152 | clade_298 | N | N |
| *Propionibacterium acnes* | 1570 | ADJM01000010 | clade_299 | N | N |
| *Propionibacterium* sp. 434_HC2 | 1576 | AFIL01000035 | clade_299 | N | N |
| *Propionibacterium* sp. LG | 1578 | AY354921 | clade_299 | N | N |
| *Propionibacterium* sp. S555a | 1579 | AB264622 | clade_299 | N | N |
| *Alicyclobacillus* sp. CCUG 53762 | 128 | HE613268 | clade_301 | N | N |
| *Actinomyces cardiffensis* | 53 | GU470888 | clade_303 | N | N |
| *Actinomyces funkei* | 55 | HQ906497 | clade_303 | N | N |
| *Actinomyces* sp. HKU31 | 74 | HQ335393 | clade_303 | N | N |
| *Actinomyces* sp. oral taxon C55 | 94 | HM099646 | clade_303 | N | N |
| *Kerstersia gyiorum* | 1018 | NR_025669 | clade_307 | N | N |
| *Pigmentiphaga daeguensis* | 1467 | JN585327 | clade_307 | N | N |
| *Aeromonas allosaccharophila* | 104 | S39232 | clade_308 | N | N |
| *Aeromonas enteropelogenes* | 105 | X71121 | clade_308 | N | N |
| *Aeromonas hydrophila* | 106 | NC_008570 | clade_308 | N | N |
| *Aeromonas jandaei* | 107 | X60413 | clade_308 | N | N |
| *Aeromonas salmonicida* | 108 | NC_009348 | clade_308 | N | N |
| *Aeromonas trota* | 109 | X60415 | clade_308 | N | N |
| *Aeromonas veronii* | 110 | NR_044845 | clade_308 | N | N |
| *Marvinbryantia formatexigens* | 1196 | AJ505973 | clade_309 | N | N |
| *Rhodobacter* sp. oral taxon C30 | 1620 | HM099648 | clade_310 | N | N |
| *Rhodobacter sphaeroides* | 1621 | CP000144 | clade_310 | N | N |
| *Lactobacillus antri* | 1071 | ACLL01000037 | clade_313 | N | N |
| *Lactobacillus coleohominis* | 1076 | ACOH01000030 | clade_313 | N | N |
| *Lactobacillus fermentum* | 1083 | CP002033 | clade_313 | N | N |
| *Lactobacillus gastricus* | 1085 | AICN01000060 | clade_313 | N | N |
| *Lactobacillus mucosae* | 1099 | FR693800 | clade_313 | N | N |
| *Lactobacillus oris* | 1103 | AEKL01000077 | clade_313 | N | N |
| *Lactobacillus pontis* | 1111 | HM218420 | clade_313 | N | N |
| *Lactobacillus reuteri* | 1112 | ACGW02000012 | clade_313 | N | N |
| *Lactobacillus* sp. KLDS 1.0707 | 1127 | EU600911 | clade_313 | N | N |
| *Lactobacillus* sp. KLDS 1.0709 | 1128 | EU600913 | clade_313 | N | N |
| *Lactobacillus* sp. KLDS 1.0711 | 1129 | EU600915 | clade_313 | N | N |
| *Lactobacillus* sp. KLDS 1.0713 | 1131 | EU600917 | clade_313 | N | N |
| *Lactobacillus* sp. KLDS 1.0716 | 1132 | EU600921 | clade_313 | N | N |
| *Lactobacillus* sp. KLDS 1.0718 | 1133 | EU600922 | clade_313 | N | N |
| *Lactobacillus* sp. oral taxon 052 | 1137 | GQ422710 | clade_313 | N | N |
| *Lactobacillus vaginalis* | 1140 | ACGV01000168 | clade_313 | N | N |
| *Brevibacterium aurantiacum* | 419 | NR_044854 | clade_314 | N | N |

TABLE 1-continued

List of Operational Taxonomic Units (OTU) with taxonomic assignments made to Genus, Species, and Phylogenetic Clade.

| OTU | SEQ ID Number | Public DB Accession | Clade | Spore Former | Pathogen Status |
|---|---|---|---|---|---|
| *Brevibacterium linens* | 423 | AJ315491 | clade_314 | N | N |
| *Lactobacillus pentosus* | 1108 | JN813103 | clade_315 | N | N |
| *Lactobacillus plantarum* | 1110 | ACGZ02000033 | clade_315 | N | N |
| *Lactobacillus* sp. KLDS 1.0702 | 1123 | EU600906 | clade_315 | N | N |
| *Lactobacillus* sp. KLDS 1.0703 | 1124 | EU600907 | clade_315 | N | N |
| *Lactobacillus* sp. KLDS 1.0704 | 1125 | EU600908 | clade_315 | N | N |
| *Lactobacillus* sp. KLDS 1.0705 | 1126 | EU600909 | clade_315 | N | N |
| *Agrobacterium radiobacter* | 115 | CP000628 | clade_316 | N | N |
| *Agrobacterium tumefaciens* | 116 | AJ389893 | clade_316 | N | N |
| *Corynebacterium argentoratense* | 685 | EF463055 | clade_317 | N | N |
| *Corynebacterium diphtheriae* | 693 | NC_002935 | clade_317 | N | OP |
| *Corynebacterium pseudotuberculosis* | 715 | NR_037070 | clade_317 | N | N |
| *Corynebacterium renale* | 717 | NR_037069 | clade_317 | N | N |
| *Corynebacterium ulcerans* | 731 | NR_074467 | clade_317 | N | N |
| *Aurantimonas coralicida* | 191 | AY065627 | clade_318 | N | N |
| *Aureimonas altamirensis* | 192 | FN658986 | clade_318 | N | N |
| *Lactobacillus acidipiscis* | 1066 | NR_024718 | clade_320 | N | N |
| *Lactobacillus salivarius* | 1117 | AEBA01000145 | clade_320 | N | N |
| *Lactobacillus* sp. KLDS 1.0719 | 1134 | EU600923 | clade_320 | N | N |
| *Lactobacillus buchneri* | 1073 | ACGH01000101 | clade_321 | N | N |
| *Lactobacillus* genomosp. C1 | 1086 | AY278619 | clade_321 | N | N |
| *Lactobacillus* genomosp. C2 | 1087 | AY278620 | clade_321 | N | N |
| *Lactobacillus hilgardii* | 1089 | ACGP01000200 | clade_321 | N | N |
| *Lactobacillus kefiri* | 1096 | NR_042230 | clade_321 | N | N |
| *Lactobacillus parabuchneri* | 1105 | NR_041294 | clade_321 | N | N |
| *Lactobacillus parakefiri* | 1107 | NR_029039 | clade_321 | N | N |
| *Lactobacillus curvatus* | 1079 | NR_042437 | clade_322 | N | N |
| *Lactobacillus sakei* | 1116 | DQ989236 | clade_322 | N | N |
| *Aneurinibacillus aneurinilyticus* | 167 | AB101592 | clade_323 | N | N |
| *Aneurinibacillus danicus* | 168 | NR_028657 | clade_323 | N | N |
| *Aneurinibacillus migulanus* | 169 | NR_036799 | clade_323 | N | N |
| *Aneurinibacillus terranovensis* | 170 | NR_042271 | clade_323 | N | N |
| *Staphylococcus aureus* | 1757 | CP002643 | clade_325 | N | Category-B |
| *Staphylococcus auricularis* | 1758 | JQ624774 | clade_325 | N | N |
| *Staphylococcus capitis* | 1759 | ACFR01000029 | clade_325 | N | N |
| *Staphylococcus caprae* | 1760 | ACRH01000033 | clade_325 | N | N |
| *Staphylococcus carnosus* | 1761 | NR_075003 | clade_325 | N | N |
| *Staphylococcus cohnii* | 1762 | JN175375 | clade_325 | N | N |
| *Staphylococcus condimenti* | 1763 | NR_029345 | clade_325 | N | N |
| *Staphylococcus epidermidis* | 1764 | ACHE01000056 | clade_325 | N | N |
| *Staphylococcus equorum* | 1765 | NR_027520 | clade_325 | N | N |
| *Staphylococcus haemolyticus* | 1767 | NC_007168 | clade_325 | N | N |
| *Staphylococcus hominis* | 1768 | AM157418 | clade_325 | N | N |
| *Staphylococcus lugdunensis* | 1769 | AEQA01000024 | clade_325 | N | N |
| *Staphylococcus pasteuri* | 1770 | FJ189773 | clade_325 | N | N |
| *Staphylococcus pseudintermedius* | 1771 | CP002439 | clade_325 | N | N |
| *Staphylococcus saccharolyticus* | 1772 | NR_029158 | clade_325 | N | N |
| *Staphylococcus saprophyticus* | 1773 | NC_007350 | clade_325 | N | N |
| *Staphylococcus* sp. clone bottae7 | 1777 | AF467424 | clade_325 | N | N |
| *Staphylococcus* sp. H292 | 1775 | AB177642 | clade_325 | N | N |
| *Staphylococcus* sp. H780 | 1776 | AB177644 | clade_325 | N | N |
| *Staphylococcus succinus* | 1778 | NR_028667 | clade_325 | N | N |
| *Staphylococcus warneri* | 1780 | ACPZ01000009 | clade_325 | N | N |
| *Staphylococcus xylosus* | 1781 | AY395016 | clade_325 | N | N |
| *Cardiobacterium hominis* | 490 | ACKY01000036 | clade_326 | N | N |
| *Cardiobacterium valvarum* | 491 | NR_028847 | clade_326 | N | N |
| *Pseudomonas fluorescens* | 1593 | AY622220 | clade_326 | N | N |
| *Pseudomonas gessardii* | 1594 | FJ943496 | clade_326 | N | N |
| *Pseudomonas monteilii* | 1596 | NR_024910 | clade_326 | N | N |
| *Pseudomonas poae* | 1597 | GU188951 | clade_326 | N | N |
| *Pseudomonas putida* | 1599 | AF094741 | clade_326 | N | N |
| *Pseudomonas* sp. G1229 | 1601 | DQ910482 | clade_326 | N | N |
| *Pseudomonas tolaasii* | 1604 | AF320988 | clade_326 | N | N |
| *Pseudomonas viridiflava* | 1605 | NR_042764 | clade_326 | N | N |
| *Listeria grayi* | 1185 | ACCR02000003 | clade_328 | N | OP |
| *Listeria innocua* | 1186 | JF967625 | clade_328 | N | N |
| *Listeria ivanovii* | 1187 | X56151 | clade_328 | N | N |
| *Listeria monocytogenes* | 1188 | CP002003 | clade_328 | N | Category-B |
| *Listeria welshimeri* | 1189 | AM263198 | clade_328 | N | OP |
| *Capnocytophaga* sp. oral clone ASCH05 | 484 | AY923149 | clade_333 | N | N |
| *Capnocytophaga sputigena* | 489 | ABZV01000054 | clade_333 | N | N |
| *Leptotrichia* genomosp. C1 | 1166 | AY278621 | clade_334 | N | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| *Leptotrichia shahii* | 1169 | AY029806 | clade_334 | N | N |
| *Leptotrichia* sp. neutropenic Patient | 1170 | AF189244 | clade_334 | N | N |
| *Leptotrichia* sp. oral clone GT018 | 1171 | AY349384 | clade_334 | N | N |
| *Leptotrichia* sp. oral clone GT020 | 1172 | AY349385 | clade_334 | N | N |
| *Bacteroides* sp. 20_3 | 296 | ACRQ01000064 | clade_335 | N | N |
| *Bacteroides* sp. 3_1_19 | 307 | ADCJ01000062 | clade_335 | N | N |
| *Bacteroides* sp. 3_2_5 | 311 | ACIB01000079 | clade_335 | N | N |
| *Parabacteroides distasonis* | 1416 | CP000140 | clade_335 | N | N |
| *Parabacteroides goldsteinii* | 1417 | AY974070 | clade_335 | N | N |
| *Parabacteroides gordonii* | 1418 | AB470344 | clade_335 | N | N |
| *Parabacteroides* sp. D13 | 1421 | ACPW01000017 | clade_335 | N | N |
| *Capnocytophaga* genomosp. C1 | 477 | AY278613 | clade_336 | N | N |
| *Capnocytophaga ochracea* | 480 | AEOH01000054 | clade_336 | N | N |
| *Capnocytophaga* sp. GEJ8 | 481 | GU561335 | clade_336 | N | N |
| *Capnocytophaga* sp. oral strain A47ROY | 486 | AY005077 | clade_336 | N | N |
| *Capnocytophaga* sp. S1b | 482 | U42009 | clade_336 | N | N |
| *Paraprevotella clara* | 1426 | AFFY01000068 | clade_336 | N | N |
| *Bacteroides heparinolyticus* | 282 | JN867284 | clade_338 | N | N |
| *Prevotella heparinolytica* | 1500 | GQ422742 | clade_338 | N | N |
| *Treponema* genomosp. P4 oral clone MB2_G19 | 1928 | DQ003618 | clade_339 | N | N |
| *Treponema* genomosp. P6 oral clone MB4_G11 | 1930 | DQ003625 | clade_339 | N | N |
| *Treponema* sp. oral taxon 254 | 1952 | GU408803 | clade_339 | N | N |
| *Treponema* sp. oral taxon 508 | 1956 | GU413616 | clade_339 | N | N |
| *Treponema* sp. oral taxon 518 | 1957 | GU413640 | clade_339 | N | N |
| *Chlamydia muridarum* | 502 | AE002160 | clade_341 | N | OP |
| *Chlamydia trachomatis* | 504 | U68443 | clade_341 | N | OP |
| *Chlamydia psittaci* | 503 | NR_036864 | clade_342 | N | Category-B |
| *Chlamydophila pneumoniae* | 509 | NC_002179 | clade_342 | N | OP |
| *Chlamydophila psittaci* | 510 | D85712 | clade_342 | N | OP |
| *Anaerococcus octavius* | 146 | NR_026360 | clade_343 | N | N |
| *Anaerococcus* sp. 8405254 | 149 | HM587319 | clade_343 | N | N |
| *Anaerococcus* sp. 9401487 | 150 | HM587322 | clade_343 | N | N |
| *Anaerococcus* sp. 9403502 | 151 | HM587325 | clade_343 | N | N |
| *Gardnerella vaginalis* | 923 | CP001849 | clade_344 | N | N |
| *Campylobacter lari* | 466 | CP000932 | clade_346 | N | OP |
| *Anaerobiospirillum succiniciproducens* | 142 | NR_026075 | clade_347 | N | N |
| *Anaerobiospirillum thomasii* | 143 | AJ420985 | clade_347 | N | N |
| *Ruminobacter amylophilus* | 1654 | NR_026450 | clade_347 | N | N |
| *Succinatimonas hippei* | 1897 | AEVO01000027 | clade_347 | N | N |
| *Actinomyces europaeus* | 54 | NR_026363 | clade_348 | N | N |
| *Actinomyces* sp. oral clone GU009 | 82 | AY349361 | clade_348 | N | N |
| *Moraxella catarrhalis* | 1260 | CP002005 | clade_349 | N | N |
| *Moraxella lincolnii* | 1261 | FR822735 | clade_349 | N | N |
| *Moraxella* sp. 16285 | 1263 | JF682466 | clade_349 | N | N |
| *Psychrobacter* sp. 13983 | 1613 | HM212668 | clade_349 | N | N |
| *Actinobaculum massiliae* | 49 | AF487679 | clade_350 | N | N |
| *Actinobaculum schaalii* | 50 | AY957507 | clade_350 | N | N |
| *Actinobaculum* sp. BM#101342 | 51 | AY282578 | clade_350 | N | N |
| *Actinobaculum* sp. P2P_19 P1 | 52 | AY207066 | clade_350 | N | N |
| *Actinomyces* sp. oral clone IO076 | 84 | AY349363 | clade_350 | N | N |
| *Actinomyces* sp. oral taxon 848 | 93 | ACUY01000072 | clade_350 | N | N |
| *Actinomyces neuii* | 65 | X71862 | clade_352 | N | N |
| *Mobiluncus mulieris* | 1252 | ACKW01000035 | clade_352 | N | N |
| *Blastomonas natatoria* | 372 | NR_040824 | clade_356 | N | N |
| *Novosphingobium aromaticivorans* | 1357 | AAAV03000008 | clade_356 | N | N |
| *Sphingomonas* sp. oral clone FI012 | 1745 | AY349411 | clade_356 | N | N |
| *Sphingopyxis alaskensis* | 1749 | CP000356 | clade_356 | N | N |
| *Oxalobacter formigenes* | 1389 | ACDQ01000020 | clade_357 | N | N |
| *Veillonella atypica* | 1974 | AEDS01000059 | clade_358 | N | N |
| *Veillonella dispar* | 1975 | ACIK02000021 | clade_358 | N | N |
| *Veillonella* genomosp. P1 oral clone MB5_P17 | 1976 | DQ003631 | clade_358 | N | N |
| *Veillonella parvula* | 1978 | ADFU01000009 | clade_358 | N | N |
| *Veillonella* sp. 3_1_44 | 1979 | ADCV01000019 | clade_358 | N | N |
| *Veillonella* sp. 6_1_27 | 1980 | ADCW01000016 | clade_358 | N | N |
| *Veillonella* sp. ACP1 | 1981 | HQ616359 | clade_358 | N | N |
| *Veillonella* sp. AS16 | 1982 | HQ616365 | clade_358 | N | N |
| *Veillonella* sp. BS32b | 1983 | HQ616368 | clade_358 | N | N |
| *Veillonella* sp. ICM51a | 1984 | HQ616396 | clade_358 | N | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| Veillonella sp. MSA12 | 1985 | HQ616381 | clade_358 | N | N |
| Veillonella sp. NVG 100cf | 1986 | EF108443 | clade_358 | N | N |
| Veillonella sp. OK11 | 1987 | JN695650 | clade_358 | N | N |
| Veillonella sp. oral clone ASCG01 | 1990 | AY923144 | clade_358 | N | N |
| Veillonella sp. oral clone ASCG02 | 1991 | AY953257 | clade_358 | N | N |
| Veillonella sp. oral clone OH1A | 1992 | AY947495 | clade_358 | N | N |
| Veillonella sp. oral taxon 158 | 1993 | AENU01000007 | clade_358 | N | N |
| Kocuria marina | 1040 | GQ260086 | clade_365 | N | N |
| Kocuria rhizophila | 1042 | AY030315 | clade_365 | N | N |
| Kocuria rosea | 1043 | X87756 | clade_365 | N | N |
| Kocuria varians | 1044 | AF542074 | clade_365 | N | N |
| Clostridiaceae bacterium END_2 | 531 | EF451053 | clade_368 | N | N |
| Micrococcus antarcticus | 1242 | NR_025285 | clade_371 | N | N |
| Micrococcus luteus | 1243 | NR_075062 | clade_371 | N | N |
| Micrococcus lylae | 1244 | NR_026200 | clade_371 | N | N |
| Micrococcus sp. 185 | 1245 | EU714334 | clade_371 | N | N |
| Lactobacillus brevis | 1072 | EU194349 | clade_372 | N | N |
| Lactobacillus parabrevis | 1104 | NR_042456 | clade_372 | N | N |
| Pediococcus acidilactici | 1436 | ACXB01000026 | clade_372 | N | N |
| Pediococcus pentosaceus | 1437 | NR_075052 | clade_372 | N | N |
| Lactobacillus dextrinicus | 1081 | NR_036861 | clade_373 | N | N |
| Lactobacillus perolens | 1109 | NR_029360 | clade_373 | N | N |
| Lactobacillus rhamnosus | 1113 | ABWJ01000068 | clade_373 | N | N |
| Lactobacillus saniviri | 1118 | AB602569 | clade_373 | N | N |
| Lactobacillus sp. BT6 | 1121 | HQ616370 | clade_373 | N | N |
| Mycobacterium mageritense | 1282 | FR798914 | clade_374 | N | OP |
| Mycobacterium neoaurum | 1286 | AF268445 | clade_374 | N | OP |
| Mycobacterium smegmatis | 1291 | CP000480 | clade_374 | N | OP |
| Mycobacterium sp. HE5 | 1304 | AJ012738 | clade_374 | N | N |
| Dysgonomonas gadei | 775 | ADLV01000001 | clade_377 | N | N |
| Dysgonomonas mossii | 776 | ADLW01000023 | clade_377 | N | N |
| Porphyromonas levii | 1474 | NR_025907 | clade_377 | N | N |
| Porphyromonas somerae | 1476 | AB547667 | clade_377 | N | N |
| Bacteroides barnesiae | 267 | NR_041446 | clade_378 | N | N |
| Bacteroides coprocola | 272 | ABIY02000050 | clade_378 | N | N |
| Bacteroides coprophilus | 273 | ACBW01000012 | clade_378 | N | N |
| Bacteroides dorei | 274 | ABWZ01000093 | clade_378 | N | N |
| Bacteroides massiliensis | 284 | AB200226 | clade_378 | N | N |
| Bacteroides plebeius | 289 | AB200218 | clade_378 | N | N |
| Bacteroides sp. 3_1_33FAA | 309 | ACPS01000085 | clade_378 | N | N |
| Bacteroides sp. 3_1_40A | 310 | ACRT01000136 | clade_378 | N | N |
| Bacteroides sp. 4_3_47FAA | 313 | ACDR02000029 | clade_378 | N | N |
| Bacteroides sp. 9_1_42FAA | 314 | ACAA01000096 | clade_378 | N | N |
| Bacteroides sp. NB_8 | 323 | AB117565 | clade_378 | N | N |
| Bacteroides vulgatus | 331 | CP000139 | clade_378 | N | N |
| Bacteroides ovatus | 287 | ACWH01000036 | clade_38 | N | N |
| Bacteroides sp. 1_1_30 | 294 | ADCL01000128 | clade_38 | N | N |
| Bacteroides sp. 2_1_22 | 297 | ACPQ01000117 | clade_38 | N | N |
| Bacteroides sp. 2_2_4 | 299 | ABZZ01000168 | clade_38 | N | N |
| Bacteroides sp. 3_1_23 | 308 | ACRS01000081 | clade_38 | N | N |
| Bacteroides sp. D1 | 318 | ACAB02000030 | clade_38 | N | N |
| Bacteroides sp. D2 | 321 | ACGA01000077 | clade_38 | N | N |
| Bacteroides sp. D22 | 320 | ADCK01000151 | clade_38 | N | N |
| Bacteroides xylanisolvens | 332 | ADKP01000087 | clade_38 | N | N |
| Treponema lecithinolyticum | 1931 | NR_026247 | clade_380 | N | OP |
| Treponema parvum | 1933 | AF302937 | clade_380 | N | OP |
| Treponema sp. oral clone JU025 | 1940 | AY349417 | clade_380 | N | N |
| Treponema sp. oral taxon 270 | 1954 | GQ422733 | clade_380 | N | N |
| Parascardovia denticolens | 1428 | ADEB01000020 | clade_381 | N | N |
| Scardovia inopinata | 1688 | AB029087 | clade_381 | N | N |
| Scardovia wiggsiae | 1689 | AY278626 | clade_381 | N | N |
| Clostridiales bacterium 9400853 | 533 | HM587320 | clade_384 | N | N |
| Mogibacterium diversum | 1254 | NR_027191 | clade_384 | N | N |
| Mogibacterium neglectum | 1255 | NR_027203 | clade_384 | N | N |
| Mogibacterium pumilum | 1256 | NR_028608 | clade_384 | N | N |
| Mogibacterium timidum | 1257 | Z36296 | clade_384 | N | N |
| Borrelia burgdorferi | 389 | ABGI01000001 | clade_386 | N | OP |
| Borrelia garinii | 392 | ABJV01000001 | clade_386 | N | OP |
| Borrelia sp. NE49 | 397 | AJ224142 | clade_386 | N | OP |
| Caldimonas manganoxidans | 457 | NR_040787 | clade_387 | N | N |
| Comamonadaceae bacterium oral taxon F47 | 667 | HM099651 | clade_387 | N | N |
| Lautropia mirabilis | 1149 | AEQP01000026 | clade_387 | N | N |
| Lautropia sp. oral clone AP009 | 1150 | AY005030 | clade_387 | N | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| *Peptoniphilus asaccharolyticus* | 1441 | D14145 | clade_389 | N | N |
| *Peptoniphilus duerdenii* | 1442 | EU526290 | clade_389 | N | N |
| *Peptoniphilus harei* | 1443 | NR_026358 | clade_389 | N | N |
| *Peptoniphilus indolicus* | 1444 | AY153431 | clade_389 | N | N |
| *Peptoniphilus lacrimalis* | 1446 | ADDO01000050 | clade_389 | N | N |
| *Peptoniphilus* sp. gpac077 | 1450 | AM176527 | clade_389 | N | N |
| *Peptoniphilus* sp. JC140 | 1447 | JF824803 | clade_389 | N | N |
| *Peptoniphilus* sp. oral taxon 386 | 1452 | ADCS01000031 | clade_389 | N | N |
| *Peptoniphilus* sp. oral taxon 836 | 1453 | AEAA01000090 | clade_389 | N | N |
| Peptostreptococcaceae bacterium ph1 | 1454 | JN837495 | clade_389 | N | N |
| *Dialister pneumosintes* | 765 | HM596297 | clade_390 | N | N |
| *Dialister* sp. oral taxon 502 | 767 | GQ422739 | clade_390 | N | N |
| *Cupriavidus metallidurans* | 741 | GU230889 | clade_391 | N | N |
| *Herbaspirillum seropedicae* | 1001 | CP002039 | clade_391 | N | N |
| *Herbaspirillum* sp. JC206 | 1002 | JN657219 | clade_391 | N | N |
| *Janthinobacterium* sp. SY12 | 1015 | EF455530 | clade_391 | N | N |
| *Massilia* sp. CCUG 43427A | 1197 | FR773700 | clade_391 | N | N |
| *Ralstonia pickettii* | 1615 | NC_010682 | clade_391 | N | N |
| *Ralstonia* sp. 5_7_47FAA | 1616 | ACUF01000076 | clade_391 | N | N |
| *Francisella novicida* | 889 | ABSS01000002 | clade_392 | N | N |
| *Francisella philomiragia* | 890 | AY928394 | clade_392 | N | N |
| *Francisella tularensis* | 891 | ABAZ01000082 | clade_392 | N | Category-A |
| *Ignatzschineria indica* | 1009 | HQ823562 | clade_392 | N | N |
| *Ignatzschineria* sp. NML 95_0260 | 1010 | HQ823559 | clade_392 | N | N |
| *Streptococcus mutans* | 1814 | AP010655 | clade_394 | N | N |
| *Lactobacillus gasseri* | 1084 | ACOZ01000018 | clade_398 | N | N |
| *Lactobacillus hominis* | 1090 | FR681902 | clade_398 | N | N |
| *Lactobacillus iners* | 1091 | AEKJ01000002 | clade_398 | N | N |
| *Lactobacillus johnsonii* | 1093 | AE017198 | clade_398 | N | N |
| *Lactobacillus senioris* | 1119 | AB602570 | clade_398 | N | N |
| *Lactobacillus* sp. oral clone HT002 | 1135 | AY349382 | clade_398 | N | N |
| *Weissella beninensis* | 2006 | EU439435 | clade_398 | N | N |
| *Sphingomonas echinoides* | 1744 | NR_024700 | clade_399 | N | N |
| *Sphingomonas* sp. oral taxon A09 | 1747 | HM099639 | clade_399 | N | N |
| *Sphingomonas* sp. oral taxon F71 | 1748 | HM099645 | clade_399 | N | N |
| *Zymomonas mobilis* | 2032 | NR_074274 | clade_399 | N | N |
| *Arcanobacterium haemolyticum* | 174 | NR_025347 | clade_400 | N | N |
| *Arcanobacterium pyogenes* | 175 | GU585578 | clade_400 | N | N |
| *Trueperella pyogenes* | 1962 | NR_044858 | clade_400 | N | N |
| *Lactococcus garvieae* | 1144 | AF061005 | clade_401 | N | N |
| *Lactococcus lactis* | 1145 | CP002365 | clade_401 | N | N |
| *Brevibacterium mcbrellneri* | 424 | ADNU01000076 | clade_402 | N | N |
| *Brevibacterium paucivorans* | 425 | EU086796 | clade_402 | N | N |
| *Brevibacterium* sp. JC43 | 428 | JF824806 | clade_402 | N | N |
| *Selenomonas artemidis* | 1692 | HM596274 | clade_403 | N | N |
| *Selenomonas* sp. FOBRC9 | 1704 | HQ616378 | clade_403 | N | N |
| *Selenomonas* sp. oral taxon 137 | 1715 | AENV01000007 | clade_403 | N | N |
| *Desmospora activa* | 751 | AM940019 | clade_404 | N | N |
| *Desmospora* sp. 8437 | 752 | AFHT01000143 | clade_404 | N | N |
| *Paenibacillus* sp. oral taxon F45 | 1407 | HM099647 | clade_404 | N | N |
| *Corynebacterium ammoniagenes* | 682 | ADNS01000011 | clade_405 | N | N |
| *Corynebacterium aurimucosum* | 687 | ACLH01000041 | clade_405 | N | N |
| *Corynebacterium bovis* | 688 | AF537590 | clade_405 | N | N |
| *Corynebacterium canis* | 689 | GQ871934 | clade_405 | N | N |
| *Corynebacterium casei* | 690 | NR_025101 | clade_405 | N | N |
| *Corynebacterium durum* | 694 | Z97069 | clade_405 | N | N |
| *Corynebacterium efficiens* | 695 | ACLI01000121 | clade_405 | N | N |
| *Corynebacterium falsenii* | 696 | Y13024 | clade_405 | N | N |
| *Corynebacterium flavescens* | 697 | NR_037040 | clade_405 | N | N |
| *Corynebacterium glutamicum* | 701 | BA000036 | clade_405 | N | N |
| *Corynebacterium jeikeium* | 704 | ACYW01000001 | clade_405 | N | OP |
| *Corynebacterium kroppenstedtii* | 705 | NR_026380 | clade_405 | N | N |
| *Corynebacterium lipophiloflavum* | 706 | ACHJ01000075 | clade_405 | N | N |
| *Corynebacterium matruchotii* | 709 | ACSH02000003 | clade_405 | N | N |
| *Corynebacterium minutissimum* | 710 | X82064 | clade_405 | N | N |
| *Corynebacterium resistens* | 718 | ADGN01000058 | clade_405 | N | N |
| *Corynebacterium simulans* | 720 | AF537604 | clade_405 | N | N |
| *Corynebacterium singulare* | 721 | NR_026394 | clade_405 | N | N |
| *Corynebacterium* sp. 1 ex sheep | 722 | Y13427 | clade_405 | N | N |
| *Corynebacterium* sp. NML 99_0018 | 726 | GU238413 | clade_405 | N | N |
| *Corynebacterium striatum* | 727 | ACGE01000001 | clade_405 | N | OP |
| *Corynebacterium urealyticum* | 732 | X81913 | clade_405 | N | OP |

TABLE 1-continued

List of Operational Taxonomic Units (OTU) with taxonomic assignments made to Genus, Species, and Phylogenetic Clade.

| OTU | SEQ ID Number | Public DB Accession | Clade | Spore Former | Pathogen Status |
|---|---|---|---|---|---|
| *Corynebacterium variabile* | 734 | NR_025314 | clade_405 | N | N |
| *Aerococcus sanguinicola* | 98 | AY837833 | clade_407 | N | N |
| *Aerococcus urinae* | 99 | CP002512 | clade_407 | N | N |
| *Aerococcus urinaeequi* | 100 | NR_043443 | clade_407 | N | N |
| *Aerococcus viridans* | 101 | ADNT01000041 | clade_407 | N | N |
| *Fusobacterium naviforme* | 898 | HQ223106 | clade_408 | N | N |
| *Moryella indoligenes* | 1268 | AF527773 | clade_408 | N | N |
| *Selenomonas* genomosp. P5 | 1697 | AY341820 | clade_410 | N | N |
| *Selenomonas* sp. oral clone IQ048 | 1710 | AY349408 | clade_410 | N | N |
| *Selenomonas sputigena* | 1717 | ACKP02000033 | clade_410 | N | N |
| *Hyphomicrobium sulfonivorans* | 1007 | AY468372 | clade_411 | N | N |
| *Methylocella silvestris* | 1228 | NR_074237 | clade_411 | N | N |
| *Legionella pneumophila* | 1153 | NC_002942 | clade_412 | N | OP |
| *Lactobacillus coryniformis* | 1077 | NR_044705 | clade_413 | N | N |
| *Arthrobacter agilis* | 178 | NR_026198 | clade_414 | N | N |
| *Arthrobacter arilaitensis* | 179 | NR_074608 | clade_414 | N | N |
| *Arthrobacter bergerei* | 180 | NR_025612 | clade_414 | N | N |
| *Arthrobacter globiformis* | 181 | NR_026187 | clade_414 | N | N |
| *Arthrobacter nicotianae* | 182 | NR_026190 | clade_414 | N | N |
| *Mycobacterium abscessus* | 1269 | AGQU01000002 | clade_418 | N | OP |
| *Mycobacterium chelonae* | 1273 | AB548610 | clade_418 | N | OP |
| *Bacteroides salanitronis* | 291 | CP002530 | clade_419 | N | N |
| *Paraprevotella xylaniphila* | 1427 | AFBR01000011 | clade_419 | N | N |
| *Barnesiella intestinihominis* | 336 | AB370251 | clade_420 | N | N |
| *Barnesiella viscericola* | 337 | NR_041508 | clade_420 | N | N |
| *Parabacteroides* sp. NS31_3 | 1422 | JN029805 | clade_420 | N | N |
| Porphyromonadaceae bacterium NML 060648 | 1470 | EF184292 | clade_420 | N | N |
| *Tannerella forsythia* | 1913 | CP003191 | clade_420 | N | N |
| *Tannerella* sp. 6_1_58FAA_CT1 | 1914 | ACWX01000068 | clade_420 | N | N |
| *Mycoplasma amphoriforme* | 1311 | AY531656 | clade_421 | N | N |
| *Mycoplasma genitalium* | 1317 | L43967 | clade_421 | N | N |
| *Mycoplasma pneumoniae* | 1322 | NC_000912 | clade_421 | N | N |
| *Mycoplasma penetrans* | 1321 | NC_004432 | clade_422 | N | N |
| *Ureaplasma parvum* | 1966 | AE002127 | clade_422 | N | N |
| *Ureaplasma urealyticum* | 1967 | AAYN01000002 | clade_422 | N | N |
| *Treponema* genomosp. P1 | 1927 | AY341822 | clade_425 | N | N |
| *Treponema* sp. oral taxon 228 | 1943 | GU408580 | clade_425 | N | N |
| *Treponema* sp. oral taxon 230 | 1944 | GU408603 | clade_425 | N | N |
| *Treponema* sp. oral taxon 231 | 1945 | GU408631 | clade_425 | N | N |
| *Treponema* sp. oral taxon 232 | 1946 | GU408646 | clade_425 | N | N |
| *Treponema* sp. oral taxon 235 | 1947 | GU408673 | clade_425 | N | N |
| *Treponema* sp. ovine footrot | 1959 | AJ010951 | clade_425 | N | N |
| *Treponema vincentii* | 1960 | ACYH01000036 | clade_425 | N | OP |
| Burkholderiales bacterium 1_1_47 | 452 | ADCQ01000066 | clade_432 | N | OP |
| *Parasutterella excrementihominis* | 1429 | AFBP01000029 | clade_432 | N | N |
| *Parasutterella secunda* | 1430 | AB491209 | clade_432 | N | N |
| *Sutterella morbirenis* | 1898 | AJ832129 | clade_432 | N | N |
| *Sutterella sanguinus* | 1900 | AJ748647 | clade_432 | N | N |
| *Sutterella* sp. YIT 12072 | 1901 | AB491210 | clade_432 | N | N |
| *Sutterella stercoricanis* | 1902 | NR_025600 | clade_432 | N | N |
| *Sutterella wadsworthensis* | 1903 | ADMF01000048 | clade_432 | N | N |
| *Propionibacterium freudenreichii* | 1572 | NR_036972 | clade_433 | N | N |
| *Propionibacterium* sp. oral taxon 192 | 1580 | GQ422728 | clade_433 | N | N |
| *Tessaracoccus* sp. oral taxon F04 | 1917 | HM099640 | clade_433 | N | N |
| *Peptoniphilus ivorii* | 1445 | Y07840 | clade_434 | N | N |
| *Peptoniphilus* sp. gpac007 | 1448 | AM176517 | clade_434 | N | N |
| *Peptoniphilus* sp. gpac018A | 1449 | AM176519 | clade_434 | N | N |
| *Peptoniphilus* sp. gpac148 | 1451 | AM176535 | clade_434 | N | N |
| *Flexispira rappini* | 887 | AY126479 | clade_436 | N | N |
| *Helicobacter bilis* | 993 | ACDN01000023 | clade_436 | N | N |
| *Helicobacter cinaedi* | 995 | ABQT01000054 | clade_436 | N | N |
| *Helicobacter* sp. None | 998 | U44756 | clade_436 | N | N |
| *Brevundimonas subvibrioides* | 429 | CP002102 | clade_438 | N | N |
| *Hyphomonas neptunium* | 1008 | NR_074092 | clade_438 | N | N |
| *Phenylobacterium zucineum* | 1465 | AY628697 | clade_438 | N | N |
| *Streptococcus downei* | 1793 | AEKN01000002 | clade_441 | N | N |
| *Streptococcus* sp. SHV515 | 1848 | Y07601 | clade_441 | N | N |
| *Acinetobacter* sp. CIP 53.82 | 40 | JQ638584 | clade_443 | N | N |
| *Halomonas elongata* | 990 | NR_074782 | clade_443 | N | N |
| *Halomonas johnsoniae* | 991 | FR775979 | clade_443 | N | N |
| *Butyrivibrio fibrisolvens* | 456 | U41172 | clade_444 | N | N |
| *Roseburia* sp. 11SE37 | 1640 | FM954975 | clade_444 | N | N |

TABLE 1-continued

List of Operational Taxonomic Units (OTU) with taxonomic assignments made to Genus, Species, and Phylogenetic Clade.

| OTU | SEQ ID Number | Public DB Accession | Clade | Spore Former | Pathogen Status |
|---|---|---|---|---|---|
| *Roseburia* sp. 11SE38 | 1641 | FM954976 | clade_444 | N | N |
| *Shuttleworthia satelles* | 1728 | ACIP02000004 | clade_444 | N | N |
| *Shuttleworthia* sp. MSX8B | 1729 | HQ616383 | clade_444 | N | N |
| *Shuttleworthia* sp. oral taxon G69 | 1730 | GU432167 | clade_444 | N | N |
| *Bdellovibrio* sp. MPA | 344 | AY294215 | clade_445 | N | N |
| *Desulfobulbus* sp. oral clone CH031 | 755 | AY005036 | clade_445 | N | N |
| *Desulfovibrio desulfuricans* | 757 | DQ092636 | clade_445 | N | N |
| *Desulfovibrio fairfieldensis* | 758 | U42221 | clade_445 | N | N |
| *Desulfovibrio piger* | 759 | AF192152 | clade_445 | N | N |
| *Desulfovibrio* sp. 3_1_syn3 | 760 | ADDR01000239 | clade_445 | N | N |
| *Geobacter bemidjiensis* | 941 | CP001124 | clade_445 | N | N |
| *Brachybacterium alimentarium* | 401 | NR_026269 | clade_446 | N | N |
| *Brachybacterium conglomeratum* | 402 | AB537169 | clade_446 | N | N |
| *Brachybacterium tyrofermentans* | 403 | NR_026272 | clade_446 | N | N |
| *Dermabacter hominis* | 749 | FJ263375 | clade_446 | N | N |
| *Aneurinibacillus thermoaerophilus* | 171 | NR_029303 | clade_448 | N | N |
| *Brevibacillus agri* | 409 | NR_040983 | clade_448 | N | N |
| *Brevibacillus centrosporus* | 411 | NR_043414 | clade_448 | N | N |
| *Brevibacillus choshinensis* | 412 | NR_040980 | clade_448 | N | N |
| *Brevibacillus invocatus* | 413 | NR_041836 | clade_448 | N | N |
| *Brevibacillus parabrevis* | 415 | NR_040981 | clade_448 | N | N |
| *Brevibacillus reuszeri* | 416 | NR_040982 | clade_448 | N | N |
| *Brevibacillus* sp. phR | 417 | JN837488 | clade_448 | N | N |
| *Brevibacillus thermoruber* | 418 | NR_026514 | clade_448 | N | N |
| *Lactobacillus murinus* | 1100 | NR_042231 | clade_449 | N | N |
| *Lactobacillus oeni* | 1102 | NR_043095 | clade_449 | N | N |
| *Lactobacillus ruminis* | 1115 | ACGS02000043 | clade_449 | N | N |
| *Lactobacillus vini* | 1141 | NR_042196 | clade_449 | N | N |
| *Gemella haemolysans* | 924 | ACDZ02000012 | clade_450 | N | N |
| *Gemella morbillorum* | 925 | NR_025904 | clade_450 | N | N |
| *Gemella morbillorum* | 926 | ACRX01000010 | clade_450 | N | N |
| *Gemella sanguinis* | 927 | ACRY01000057 | clade_450 | N | N |
| *Gemella* sp. oral clone ASCE02 | 929 | AY923133 | clade_450 | N | N |
| *Gemella* sp. oral clone ASCF04 | 930 | AY923139 | clade_450 | N | N |
| *Gemella* sp. oral clone ASCF12 | 931 | AY923143 | clade_450 | N | N |
| *Gemella* sp. WAL 1945J | 928 | EU427463 | clade_450 | N | N |
| *Sporolactobacillus nakayamae* | 1753 | NR_042247 | clade_451 | N | N |
| *Gluconacetobacter entanii* | 945 | NR_028909 | clade_452 | N | N |
| *Gluconacetobacter europaeus* | 946 | NR_026513 | clade_452 | N | N |
| *Gluconacetobacter hansenii* | 947 | NR_026133 | clade_452 | N | N |
| *Gluconacetobacter oboediens* | 949 | NR_041295 | clade_452 | N | N |
| *Gluconacetobacter xylinus* | 950 | NR_074338 | clade_452 | N | N |
| *Auritibacter ignavus* | 193 | FN554542 | clade_453 | N | N |
| *Dermacoccus* sp. Ellin185 | 750 | AEIQ01000090 | clade_453 | N | N |
| *Janibacter limosus* | 1013 | NR_026362 | clade_453 | N | N |
| *Janibacter melonis* | 1014 | EF063716 | clade_453 | N | N |
| *Acetobacter aceti* | 7 | NR_026121 | clade_454 | N | N |
| *Acetobacter fabarum* | 8 | NR_042678 | clade_454 | N | N |
| *Acetobacter lovaniensis* | 9 | NR_040832 | clade_454 | N | N |
| *Acetobacter malorum* | 10 | NR_025513 | clade_454 | N | N |
| *Acetobacter orientalis* | 11 | NR_028625 | clade_454 | N | N |
| *Acetobacter pasteurianus* | 12 | NR_026107 | clade_454 | N | N |
| *Acetobacter pomorum* | 13 | NR_042112 | clade_454 | N | N |
| *Acetobacter syzygii* | 14 | NR_040868 | clade_454 | N | N |
| *Acetobacter tropicalis* | 15 | NR_036881 | clade_454 | N | N |
| *Gluconacetobacter azotocaptans* | 943 | NR_028767 | clade_454 | N | N |
| *Gluconacetobacter diazotrophicus* | 944 | NR_074292 | clade_454 | N | N |
| *Gluconacetobacter johannae* | 948 | NR_024959 | clade_454 | N | N |
| *Nocardia brasiliensis* | 1351 | AIHV01000038 | clade_455 | N | N |
| *Nocardia cyriacigeorgica* | 1352 | HQ009486 | clade_455 | N | N |
| *Nocardia puris* | 1354 | NR_028994 | clade_455 | N | N |
| *Nocardia* sp. 01_Je_025 | 1355 | GU574059 | clade_455 | N | N |
| *Rhodococcus equi* | 1623 | ADNW01000058 | clade_455 | N | N |
| *Oceanobacillus caeni* | 1358 | NR_041533 | clade_456 | N | N |
| *Oceanobacillus* sp. Ndiop | 1359 | CAER01000083 | clade_456 | N | N |
| *Ornithinibacillus bavariensis* | 1384 | NR_044923 | clade_456 | N | N |
| *Ornithinibacillus* sp. 7_10AIA | 1385 | FN397526 | clade_456 | N | N |
| *Virgibacillus proomii* | 2005 | NR_025308 | clade_456 | N | N |
| *Corynebacterium amycolatum* | 683 | ABZU01000033 | clade_457 | N | OP |
| *Corynebacterium hansenii* | 702 | AM946639 | clade_457 | N | N |
| *Corynebacterium xerosis* | 735 | FN179330 | clade_457 | N | OP |
| Staphylococcaceae bacterium NML 92_0017 | 1756 | AY841362 | clade_458 | N | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| *Staphylococcus fleurettii* | 1766 | NR_041326 | clade_458 | N | N |
| *Staphylococcus sciuri* | 1774 | NR_025520 | clade_458 | N | N |
| *Staphylococcus vitulinus* | 1779 | NR_024670 | clade_458 | N | N |
| *Stenotrophomonas maltophilia* | 1782 | AAVZ01000005 | clade_459 | N | N |
| *Stenotrophomonas* sp. FG_6 | 1783 | EF017810 | clade_459 | N | N |
| *Mycobacterium africanum* | 1270 | AF480605 | clade_46 | N | OP |
| *Mycobacterium alsiensis* | 1271 | AJ938169 | clade_46 | N | OP |
| *Mycobacterium avium* | 1272 | CP000479 | clade_46 | N | OP |
| *Mycobacterium colombiense* | 1274 | AM062764 | clade_46 | N | OP |
| *Mycobacterium gordonae* | 1276 | GU142930 | clade_46 | N | OP |
| *Mycobacterium intracellulare* | 1277 | GQ153276 | clade_46 | N | OP |
| *Mycobacterium kansasii* | 1278 | AF480601 | clade_46 | N | OP |
| *Mycobacterium lacus* | 1279 | NR_025175 | clade_46 | N | OP |
| *Mycobacterium leprae* | 1280 | FM211192 | clade_46 | N | OP |
| *Mycobacterium lepromatosis* | 1281 | EU203590 | clade_46 | N | OP |
| *Mycobacterium mantenii* | 1283 | FJ042897 | clade_46 | N | OP |
| *Mycobacterium marinum* | 1284 | NC_010612 | clade_46 | N | OP |
| *Mycobacterium microti* | 1285 | NR_025234 | clade_46 | N | OP |
| *Mycobacterium parascrofulaceum* | 1287 | ADNV01000350 | clade_46 | N | OP |
| *Mycobacterium seoulense* | 1290 | DQ536403 | clade_46 | N | OP |
| *Mycobacterium* sp. 1761 | 1292 | EU703150 | clade_46 | N | N |
| *Mycobacterium* sp. 1791 | 1295 | EU703148 | clade_46 | N | N |
| *Mycobacterium* sp. 1797 | 1296 | EU703149 | clade_46 | N | N |
| *Mycobacterium* sp. B10_07.09.0206 | 1298 | HQ174245 | clade_46 | N | N |
| *Mycobacterium* sp. NLA001000736 | 1305 | HM627011 | clade_46 | N | N |
| *Mycobacterium* sp. W | 1306 | DQ437715 | clade_46 | N | N |
| *Mycobacterium tuberculosis* | 1307 | CP001658 | clade_46 | N | Category-C |
| *Mycobacterium ulcerans* | 1308 | AB548725 | clade_46 | N | OP |
| *Mycobacterium vulneris* | 1309 | EU834055 | clade_46 | N | OP |
| *Xanthomonas campestris* | 2016 | EF101975 | clade_461 | N | N |
| *Xanthomonas* sp. kmd_489 | 2017 | EU723184 | clade_461 | N | N |
| *Dietzia natronolimnaea* | 769 | GQ870426 | clade_462 | N | N |
| *Dietzia* sp. BBDP51 | 770 | DQ337512 | clade_462 | N | N |
| *Dietzia* sp. CA149 | 771 | GQ870422 | clade_462 | N | N |
| *Dietzia timorensis* | 772 | GQ870424 | clade_462 | N | N |
| *Gordonia bronchialis* | 951 | NR_027594 | clade_463 | N | N |
| *Gordonia polyisoprenivorans* | 952 | DQ385609 | clade_463 | N | N |
| *Gordonia* sp. KTR9 | 953 | DQ068383 | clade_463 | N | N |
| *Gordonia sputi* | 954 | FJ536304 | clade_463 | N | N |
| *Gordonia terrae* | 955 | GQ848239 | clade_463 | N | N |
| *Leptotrichia goodfellowii* | 1167 | ADAD01000110 | clade_465 | N | N |
| *Leptotrichia* sp. oral clone IK040 | 1174 | AY349387 | clade_465 | N | N |
| *Leptotrichia* sp. oral clone P2PB_51 P1 | 1175 | AY207053 | clade_465 | N | N |
| Bacteroidales genomosp. P7 oral clone MB3_P19 | 264 | DQ003623 | clade_466 | N | N |
| *Butyricimonas virosa* | 454 | AB443949 | clade_466 | N | N |
| *Odoribacter laneus* | 1363 | AB490805 | clade_466 | N | N |
| *Odoribacter splanchnicus* | 1364 | CP002544 | clade_466 | N | N |
| *Capnocytophaga gingivalis* | 478 | ACLQ01000011 | clade_467 | N | N |
| *Capnocytophaga granulosa* | 479 | X97248 | clade_467 | N | N |
| *Capnocytophaga* sp. oral clone AH015 | 483 | AY005074 | clade_467 | N | N |
| *Capnocytophaga* sp. oral strain S3 | 487 | AY005073 | clade_467 | N | N |
| *Capnocytophaga* sp. oral taxon 338 | 488 | AEXX01000050 | clade_467 | N | N |
| *Capnocytophaga canimorsus* | 476 | CP002113 | clade_468 | N | N |
| *Capnocytophaga* sp. oral clone ID062 | 485 | AY349368 | clade_468 | N | N |
| *Lactobacillus catenaformis* | 1075 | M23729 | clade_469 | N | N |
| *Lactobacillus vitulinus* | 1142 | NR_041305 | clade_469 | N | N |
| *Cetobacterium somerae* | 501 | AJ438155 | clade_470 | N | N |
| *Fusobacterium gonidiaformans* | 896 | ACET01000043 | clade_470 | N | N |
| *Fusobacterium mortiferum* | 897 | ACDB02000034 | clade_470 | N | N |
| *Fusobacterium necrogenes* | 899 | X55408 | clade_470 | N | N |
| *Fusobacterium necrophorum* | 900 | AM905356 | clade_470 | N | N |
| *Fusobacterium* sp. 12_1B | 905 | AGWJ01000070 | clade_470 | N | N |
| *Fusobacterium* sp. 3_1_5R | 911 | ACDD01000078 | clade_470 | N | N |
| *Fusobacterium* sp. D12 | 918 | ACDG02000036 | clade_470 | N | N |
| *Fusobacterium ulcerans* | 921 | ACDH01000090 | clade_470 | N | N |
| *Fusobacterium varium* | 922 | ACIE01000009 | clade_470 | N | N |
| *Mycoplasma arthritidis* | 1312 | NC_011025 | clade_473 | N | N |
| *Mycoplasma faucium* | 1314 | NR_024983 | clade_473 | N | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| Mycoplasma hominis | 1318 | AF443616 | clade_473 | N | N |
| Mycoplasma orale | 1319 | AY796060 | clade_473 | N | N |
| Mycoplasma salivarium | 1324 | M24661 | clade_473 | N | N |
| Mitsuokella jalaludinii | 1247 | NR_028840 | clade_474 | N | N |
| Mitsuokella multacida | 1248 | ABWK02000005 | clade_474 | N | N |
| Mitsuokella sp. oral taxon 521 | 1249 | GU413658 | clade_474 | N | N |
| Mitsuokella sp. oral taxon G68 | 1250 | GU432166 | clade_474 | N | N |
| Selenomonas genomosp. C1 | 1695 | AY278627 | clade_474 | N | N |
| Selenomonas genomosp. P8 oral clone MB5_P06 | 1700 | DQ003628 | clade_474 | N | N |
| Selenomonas ruminantium | 1703 | NR_075026 | clade_474 | N | N |
| Veillonellaceae bacterium oral taxon 131 | 1994 | GU402916 | clade_474 | N | N |
| Alloscardovia omnicolens | 139 | NR_042583 | clade_475 | N | N |
| Alloscardovia sp. OB7196 | 140 | AB425070 | clade_475 | N | N |
| Bifidobacterium urinalis | 366 | AJ278695 | clade_475 | N | N |
| Prevotella loescheii | 1503 | JN867231 | clade_48 | N | N |
| Prevotella sp. oral clone ASCG12 | 1530 | DQ272511 | clade_48 | N | N |
| Prevotella sp. oral clone GU027 | 1540 | AY349398 | clade_48 | N | N |
| Prevotella sp. oral taxon 472 | 1553 | ACZS01000106 | clade_48 | N | N |
| Selenomonas dianae | 1693 | GQ422719 | clade_480 | N | N |
| Selenomonas flueggei | 1694 | AF287803 | clade_480 | N | N |
| Selenomonas genomosp. C2 | 1696 | AY278628 | clade_480 | N | N |
| Selenomonas genomosp. P6 oral clone MB3_C41 | 1698 | DQ003636 | clade_480 | N | N |
| Selenomonas genomosp. P7 oral clone MB5_C08 | 1699 | DQ003627 | clade_480 | N | N |
| Selenomonas infelix | 1701 | AF287802 | clade_480 | N | N |
| Selenomonas noxia | 1702 | GU470909 | clade_480 | N | N |
| Selenomonas sp. oral clone FT050 | 1705 | AY349403 | clade_480 | N | N |
| Selenomonas sp. oral clone GI064 | 1706 | AY349404 | clade_480 | N | N |
| Selenomonas sp. oral clone GT010 | 1707 | AY349405 | clade_480 | N | N |
| Selenomonas sp. oral clone HU051 | 1708 | AY349406 | clade_480 | N | N |
| Selenomonas sp. oral clone IK004 | 1709 | AY349407 | clade_480 | N | N |
| Selenomonas sp. oral clone JI021 | 1711 | AY349409 | clade_480 | N | N |
| Selenomonas sp. oral clone JS031 | 1712 | AY349410 | clade_480 | N | N |
| Selenomonas sp. oral clone OH4A | 1713 | AY947498 | clade_480 | N | N |
| Selenomonas sp. oral clone P2PA_80 P4 | 1714 | AY207052 | clade_480 | N | N |
| Selenomonas sp. oral taxon 149 | 1716 | AEEJ01000007 | clade_480 | N | N |
| Veillonellaceae bacterium oral taxon 155 | 1995 | GU470897 | clade_480 | N | N |
| Agrococcus jenensis | 117 | NR_026275 | clade_484 | N | N |
| Microbacterium gubbeenense | 1232 | NR_025098 | clade_484 | N | N |
| Pseudoclavibacter sp. Timone | 1590 | FJ375951 | clade_484 | N | N |
| Tropheryma whipplei | 1961 | BX251412 | clade_484 | N | N |
| Zimmermannella bifida | 2031 | AB012592 | clade_484 | N | N |
| Legionella hackeliae | 1151 | M36028 | clade_486 | N | OP |
| Legionella longbeachae | 1152 | M36029 | clade_486 | N | OP |
| Legionella sp. D3923 | 1154 | JN380999 | clade_486 | N | OP |
| Legionella sp. D4088 | 1155 | JN381012 | clade_486 | N | OP |
| Legionella sp. H63 | 1156 | JF831047 | clade_486 | N | OP |
| Legionella sp. NML 93L054 | 1157 | GU062706 | clade_486 | N | OP |
| Legionella steelei | 1158 | HQ398202 | clade_486 | N | OP |
| Tatlockia micdadei | 1915 | M36032 | clade_486 | N | N |
| Helicobacter pullorum | 996 | ABQU01000097 | clade_489 | N | N |
| Acetobacteraceae bacterium AT_5844 | 16 | AGEZ01000040 | clade_490 | N | N |
| Roseomonas cervicalis | 1643 | ADVL01000363 | clade_490 | N | N |
| Roseomonas mucosa | 1644 | NR_028857 | clade_490 | N | N |
| Roseomonas sp. NML94_0193 | 1645 | AF533357 | clade_490 | N | N |
| Roseomonas sp. NML97_0121 | 1646 | AF533359 | clade_490 | N | N |
| Roseomonas sp. NML98_0009 | 1647 | AF533358 | clade_490 | N | N |
| Roseomonas sp. NML98_0157 | 1648 | AF533360 | clade_490 | N | N |
| Rickettsia akari | 1627 | CP000847 | clade_492 | N | OP |
| Rickettsia conorii | 1628 | AE008647 | clade_492 | N | OP |
| Rickettsia prowazekii | 1629 | M21789 | clade_492 | N | Category-B |
| Rickettsia rickettsii | 1630 | NC_010263 | clade_492 | N | OP |
| Rickettsia slovaca | 1631 | L36224 | clade_492 | N | OP |
| Rickettsia typhi | 1632 | AE017197 | clade_492 | N | OP |
| Anaeroglobus geminatus | 160 | AGCJ01000054 | clade_493 | N | N |
| Megasphaera genomosp. C1 | 1201 | AY278622 | clade_493 | N | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| *Megasphaera micronuciformis* | 1203 | AECS01000020 | clade_493 | N | N |
| Clostridiales genomsp. BVAB3 | 540 | CP001850 | clade_495 | N | N |
| *Tsukamurella paurometabola* | 1963 | X80628 | clade_496 | N | N |
| *Tsukamurella tyrosinosolvens* | 1964 | AB478958 | clade_496 | N | N |
| *Abiotrophia para_adiacens* | 2 | AB022027 | clade_497 | N | N |
| *Carnobacterium divergens* | 492 | NR_044706 | clade_497 | N | N |
| *Carnobacterium maltaromaticum* | 493 | NC_019425 | clade_497 | N | N |
| *Enterococcus avium* | 800 | AF133535 | clade_497 | N | N |
| *Enterococcus caccae* | 801 | AY943820 | clade_497 | N | N |
| *Enterococcus casseliflavus* | 802 | AEWT01000047 | clade_497 | N | N |
| *Enterococcus durans* | 803 | AJ276354 | clade_497 | N | N |
| *Enterococcus faecalis* | 804 | AE016830 | clade_497 | N | N |
| *Enterococcus faecium* | 805 | AM157434 | clade_497 | N | N |
| *Enterococcus gallinarum* | 806 | AB269767 | clade_497 | N | N |
| *Enterococcus gilvus* | 807 | AY033814 | clade_497 | N | N |
| *Enterococcus hawaiiensis* | 808 | AY321377 | clade_497 | N | N |
| *Enterococcus hirae* | 809 | AF061011 | clade_497 | N | N |
| *Enterococcus italicus* | 810 | AEPV01000109 | clade_497 | N | N |
| *Enterococcus mundtii* | 811 | NR_024906 | clade_497 | N | N |
| *Enterococcus raffinosus* | 812 | FN600541 | clade_497 | N | N |
| *Enterococcus* sp. BV2CASA2 | 813 | JN809766 | clade_497 | N | N |
| *Enterococcus* sp. CCRI_16620 | 814 | GU457263 | clade_497 | N | N |
| *Enterococcus* sp. F95 | 815 | FJ463817 | clade_497 | N | N |
| *Enterococcus* sp. RfL6 | 816 | AJ133478 | clade_497 | N | N |
| *Enterococcus thailandicus* | 817 | AY321376 | clade_497 | N | N |
| *Fusobacterium canifelinum* | 893 | AY162222 | clade_497 | N | N |
| *Fusobacterium* genomosp. C1 | 894 | AY278616 | clade_497 | N | N |
| *Fusobacterium* genomosp. C2 | 895 | AY278617 | clade_497 | N | N |
| *Fusobacterium periodonticum* | 902 | ACJY01000002 | clade_497 | N | N |
| *Fusobacterium* sp. 1_1_41FAA | 906 | ADGG01000053 | clade_497 | N | N |
| *Fusobacterium* sp. 11_3_2 | 904 | ACUO01000052 | clade_497 | N | N |
| *Fusobacterium* sp. 2_1_31 | 907 | ACDC02000018 | clade_497 | N | N |
| *Fusobacterium* sp. 3_1_27 | 908 | ADGF01000045 | clade_497 | N | N |
| *Fusobacterium* sp. 3_1_33 | 909 | ACQE01000178 | clade_497 | N | N |
| *Fusobacterium* sp. 3_1_36A2 | 910 | ACPU01000044 | clade_497 | N | N |
| *Fusobacterium* sp. AC18 | 912 | HQ616357 | clade_497 | N | N |
| *Fusobacterium* sp. ACB2 | 913 | HQ616358 | clade_497 | N | N |
| *Fusobacterium* sp. AS2 | 914 | HQ616361 | clade_497 | N | N |
| *Fusobacterium* sp. CM1 | 915 | HQ616371 | clade_497 | N | N |
| *Fusobacterium* sp. CM21 | 916 | HQ616375 | clade_497 | N | N |
| *Fusobacterium* sp. CM22 | 917 | HQ616376 | clade_497 | N | N |
| *Fusobacterium* sp. oral clone ASCF06 | 919 | AY923141 | clade_497 | N | N |
| *Fusobacterium* sp. oral clone ASCF11 | 920 | AY953256 | clade_497 | N | N |
| *Granulicatella adiacens* | 959 | ACKZ01000002 | clade_497 | N | N |
| *Granulicatella elegans* | 960 | AB252689 | clade_497 | N | N |
| *Granulicatella paradiacens* | 961 | AY879298 | clade_497 | N | N |
| *Granulicatella* sp. oral clone ASC02 | 963 | AY923126 | clade_497 | N | N |
| *Granulicatella* sp. oral clone ASCA05 | 964 | DQ341469 | clade_497 | N | N |
| *Granulicatella* sp. oral clone ASCB09 | 965 | AY953251 | clade_497 | N | N |
| *Granulicatella* sp. oral clone ASCG05 | 966 | AY923146 | clade_497 | N | N |
| *Tetragenococcus halophilus* | 1918 | NR_075020 | clade_497 | N | N |
| *Tetragenococcus koreensis* | 1919 | NR_043113 | clade_497 | N | N |
| *Vagococcus fluvialis* | 1973 | NR_026489 | clade_497 | N | N |
| *Chryseobacterium anthropi* | 514 | AM982793 | clade_498 | N | N |
| *Chryseobacterium gleum* | 515 | ACKQ02000003 | clade_498 | N | N |
| *Chryseobacterium hominis* | 516 | NR_042517 | clade_498 | N | N |
| *Treponema refringens* | 1936 | AF426101 | clade_499 | N | OP |
| *Treponema* sp. oral clone JU031 | 1941 | AY349416 | clade_499 | N | N |
| *Treponema* sp. oral taxon 239 | 1948 | GU408738 | clade_499 | N | N |
| *Treponema* sp. oral taxon 271 | 1955 | GU408871 | clade_499 | N | N |
| *Alistipes finegoldii* | 129 | NR_043064 | clade_500 | N | N |
| *Alistipes onderdonkii* | 131 | NR_043318 | clade_500 | N | N |
| *Alistipes putredinis* | 132 | ABFK02000017 | clade_500 | N | N |
| *Alistipes shahii* | 133 | FP929032 | clade_500 | N | N |
| *Alistipes* sp. HGB5 | 134 | AENZ01000082 | clade_500 | N | N |
| *Alistipes* sp. JC50 | 135 | JF824804 | clade_500 | N | N |
| *Alistipes* sp. RMA 9912 | 136 | GQ140629 | clade_500 | N | N |
| *Mycoplasma agalactiae* | 1310 | AF010477 | clade_501 | N | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| *Mycoplasma bovoculi* | 1313 | NR_025987 | clade_501 | N | N |
| *Mycoplasma fermentans* | 1315 | CP002458 | clade_501 | N | N |
| *Mycoplasma flocculare* | 1316 | X62699 | clade_501 | N | N |
| *Mycoplasma ovipneumoniae* | 1320 | NR_025989 | clade_501 | N | N |
| *Arcobacter butzleri* | 176 | AEPT01000071 | clade_502 | N | N |
| *Arcobacter cryaerophilus* | 177 | NR_025905 | clade_502 | N | N |
| *Campylobacter curvus* | 461 | NC_009715 | clade_502 | N | OP |
| *Campylobacter rectus* | 467 | ACFU01000050 | clade_502 | N | OP |
| *Campylobacter showae* | 468 | ACVQ01000030 | clade_502 | N | OP |
| *Campylobacter* sp. FOBRC14 | 469 | HQ616379 | clade_502 | N | OP |
| *Campylobacter* sp. FOBRC15 | 470 | HQ616380 | clade_502 | N | OP |
| *Campylobacter* sp. oral clone BB120 | 471 | AY005038 | clade_502 | N | OP |
| *Campylobacter sputorum* | 472 | NR_044839 | clade_502 | N | OP |
| *Bacteroides ureolyticus* | 330 | GQ167666 | clade_504 | N | N |
| *Campylobacter gracilis* | 463 | ACYG01000026 | clade_504 | N | OP |
| *Campylobacter hominis* | 464 | NC_009714 | clade_504 | N | OP |
| *Dialister invisus* | 762 | ACIM02000001 | clade_506 | N | N |
| *Dialister micraerophilus* | 763 | AFBB01000028 | clade_506 | N | N |
| *Dialister microaerophilus* | 764 | AENT01000008 | clade_506 | N | N |
| *Dialister propionicifaciens* | 766 | NR_043231 | clade_506 | N | N |
| *Dialister succinatiphilus* | 768 | AB370249 | clade_506 | N | N |
| *Megasphaera elsdenii* | 1200 | AY038996 | clade_506 | N | N |
| *Megasphaera* genomosp. type_1 | 1202 | ADGP01000010 | clade_506 | N | N |
| *Megasphaera* sp. BLPYG_07 | 1204 | HM990964 | clade_506 | N | N |
| *Megasphaera* sp. UPII 199_6 | 1205 | AFIJ01000040 | clade_506 | N | N |
| *Chromobacterium violaceum* | 513 | NC_005085 | clade_507 | N | N |
| *Laribacter hongkongensis* | 1148 | CP001154 | clade_507 | N | N |
| *Methylophilus* sp. ECd5 | 1229 | AY436794 | clade_507 | N | N |
| *Finegoldia magna* | 883 | ACHM02000001 | clade_509 | N | N |
| *Parvimonas micra* | 1431 | AB729072 | clade_509 | N | N |
| *Parvimonas* sp. oral taxon 110 | 1432 | AFII01000002 | clade_509 | N | N |
| *Peptostreptococcus micros* | 1456 | AM176538 | clade_509 | N | N |
| *Peptostreptococcus* sp. oral clone FJ023 | 1460 | AY349390 | clade_509 | N | N |
| *Peptostreptococcus* sp. P4P_31 P3 | 1458 | AY207059 | clade_509 | N | N |
| *Helicobacter pylori* | 997 | CP000012 | clade_510 | N | OP |
| *Anaplasma marginale* | 165 | ABOR01000019 | clade_511 | N | N |
| *Anaplasma phagocytophilum* | 166 | NC_007797 | clade_511 | N | N |
| *Ehrlichia chaffeensis* | 783 | AAIF01000035 | clade_511 | N | OP |
| *Neorickettsia risticii* | 1349 | CP001431 | clade_511 | N | N |
| *Neorickettsia sennetsu* | 1350 | NC_007798 | clade_511 | N | N |
| *Pseudoramibacter alactolyticus* | 1606 | AB036759 | clade_512 | N | N |
| *Veillonella montpellierensis* | 1977 | AF473836 | clade_513 | N | N |
| *Veillonella* sp. oral clone ASCA08 | 1988 | AY923118 | clade_513 | N | N |
| *Veillonella* sp. oral clone ASCB03 | 1989 | AY923122 | clade_513 | N | N |
| *Inquilinus limosus* | 1012 | NR_029046 | clade_514 | N | N |
| *Sphingomonas* sp. oral clone FZ016 | 1746 | AY349412 | clade_514 | N | N |
| *Anaerococcus lactolyticus* | 145 | ABYO01000217 | clade_515 | N | N |
| *Anaerococcus prevotii* | 147 | CP001708 | clade_515 | N | N |
| *Anaerococcus* sp. gpac104 | 152 | AM176528 | clade_515 | N | N |
| *Anaerococcus* sp. gpac126 | 153 | AM176530 | clade_515 | N | N |
| *Anaerococcus* sp. gpac155 | 154 | AM176536 | clade_515 | N | N |
| *Anaerococcus* sp. gpac199 | 155 | AM176539 | clade_515 | N | N |
| *Anaerococcus tetradius* | 157 | ACGC01000107 | clade_515 | N | N |
| *Bacteroides coagulans* | 271 | AB547639 | clade_515 | N | N |
| Clostridiales bacterium 9403326 | 534 | HM587324 | clade_515 | N | N |
| Clostridiales bacterium ph2 | 539 | JN837487 | clade_515 | N | N |
| *Peptostreptococcus* sp. 9succ1 | 1457 | X90471 | clade_515 | N | N |
| *Peptostreptococcus* sp. oral clone AP24 | 1459 | AB175072 | clade_515 | N | N |
| *Tissierella praeacuta* | 1924 | NR_044860 | clade_515 | N | N |
| *Helicobacter canadensis* | 994 | ABQS01000108 | clade_518 | N | N |
| *Peptostreptococcus anaerobius* | 1455 | AY326462 | clade_520 | N | N |
| *Peptostreptococcus stomatis* | 1461 | ADGQ01000048 | clade_520 | N | N |
| *Bilophila wadsworthia* | 367 | ADCP01000166 | clade_521 | N | N |
| *Desulfovibrio vulgaris* | 761 | NR_074897 | clade_521 | N | N |
| *Actinomyces nasicola* | 64 | AJ508455 | clade_523 | N | N |
| *Cellulosimicrobium funkei* | 500 | AY501364 | clade_523 | N | N |
| *Lactococcus raffinolactis* | 1146 | NR_044359 | clade_524 | N | N |
| Bacteroidales genomosp. P1 | 258 | AY341819 | clade_529 | N | N |

TABLE 1-continued

List of Operational Taxonomic Units (OTU) with taxonomic assignments made to Genus, Species, and Phylogenetic Clade.

| OTU | SEQ ID Number | Public DB Accession | Clade | Spore Former | Pathogen Status |
|---|---|---|---|---|---|
| Bacteroidales genomosp. P2 oral clone MB1_G13 | 259 | DQ003613 | clade_529 | N | N |
| Bacteroidales genomosp. P3 oral clone MB1_G34 | 260 | DQ003615 | clade_529 | N | N |
| Bacteroidales genomosp. P4 oral clone MB2_G17 | 261 | DQ003617 | clade_529 | N | N |
| Bacteroidales genomosp. P5 oral clone MB2_P04 | 262 | DQ003619 | clade_529 | N | N |
| Bacteroidales genomosp. P6 oral clone MB3_C19 | 263 | DQ003634 | clade_529 | N | N |
| Bacteroidales genomosp. P8 oral clone MB4_G15 | 265 | DQ003626 | clade_529 | N | N |
| Bacteroidetes bacterium oral taxon D27 | 333 | HM099638 | clade_530 | N | N |
| Bacteroidetes bacterium oral taxon F31 | 334 | HM099643 | clade_530 | N | N |
| Bacteroidetes bacterium oral taxon F44 | 335 | HM099649 | clade_530 | N | N |
| *Flavobacterium* sp. NF2_1 | 885 | FJ195988 | clade_530 | N | N |
| *Myroides odoratimimus* | 1326 | NR_042354 | clade_530 | N | N |
| *Myroides* sp. MY15 | 1327 | GU253339 | clade_530 | N | N |
| Chlamydiales bacterium NS16 | 507 | JN606076 | clade_531 | N | N |
| *Chlamydophila pecorum* | 508 | D88317 | clade_531 | N | OP |
| *Parachlamydia* sp. UWE25 | 1423 | BX908798 | clade_531 | N | N |
| *Fusobacterium russii* | 903 | NR_044687 | clade_532 | N | N |
| *Streptobacillus moniliformis* | 1784 | NR_027615 | clade_532 | N | N |
| Eubacteriaceae bacterium P4P_50 P4 | 833 | AY207060 | clade_533 | N | N |
| *Abiotrophia defectiva* | 1 | ACIN02000016 | clade_534 | N | N |
| *Abiotrophia* sp. oral clone P4PA_155 P1 | 3 | AY207063 | clade_534 | N | N |
| *Catonella* genomosp. P1 oral clone MB5_P12 | 496 | DQ003629 | clade_534 | N | N |
| *Catonella morbi* | 497 | ACIL02000016 | clade_534 | N | N |
| *Catonella* sp. oral clone FL037 | 498 | AY349369 | clade_534 | N | N |
| *Eremococcus coleocola* | 818 | AENN01000008 | clade_534 | N | N |
| *Facklamia hominis* | 879 | Y10772 | clade_534 | N | N |
| *Granulicatella* sp. M658_99_3 | 962 | AJ271861 | clade_534 | N | N |
| *Campylobacter coli* | 459 | AAFL01000004 | clade_535 | N | OP |
| *Campylobacter concisus* | 460 | CP000792 | clade_535 | N | OP |
| *Campylobacter fetus* | 462 | ACLG01001177 | clade_535 | N | OP |
| *Campylobacter jejuni* | 465 | AL139074 | clade_535 | N | Category-B |
| *Campylobacter upsaliensis* | 473 | AEPU01000040 | clade_535 | N | OP |
| *Atopobium minutum* | 183 | HM007583 | clade_539 | N | N |
| *Atopobium parvulum* | 184 | CP001721 | clade_539 | N | N |
| *Atopobium rimae* | 185 | ACFE01000007 | clade_539 | N | N |
| *Atopobium* sp. BS2 | 186 | HQ616367 | clade_539 | N | N |
| *Atopobium* sp. F0209 | 187 | EU592966 | clade_539 | N | N |
| *Atopobium* sp. ICM42b10 | 188 | HQ616393 | clade_539 | N | N |
| *Atopobium* sp. ICM57 | 189 | HQ616400 | clade_539 | N | N |
| *Atopobium vaginae* | 190 | AEDQ01000024 | clade_539 | N | N |
| Coriobacteriaceae bacterium BV3Ac1 | 677 | JN809768 | clade_539 | N | N |
| *Actinomyces naeslundii* | 63 | X81062 | clade_54 | N | N |
| *Actinomyces oricola* | 67 | NR_025559 | clade_54 | N | N |
| *Actinomyces oris* | 69 | BABV01000070 | clade_54 | N | N |
| *Actinomyces* sp. 7400942 | 70 | EU484334 | clade_54 | N | N |
| *Actinomyces* sp. ChDC B197 | 72 | AF543275 | clade_54 | N | N |
| *Actinomyces* sp. GEJ15 | 73 | GU561313 | clade_54 | N | N |
| *Actinomyces* sp. M2231_94_1 | 79 | AJ234063 | clade_54 | N | N |
| *Actinomyces* sp. oral clone GU067 | 83 | AY349362 | clade_54 | N | N |
| *Actinomyces* sp. oral clone IO077 | 85 | AY349364 | clade_54 | N | N |
| *Actinomyces* sp. oral clone IP073 | 86 | AY349365 | clade_54 | N | N |
| *Actinomyces* sp. oral clone JA063 | 88 | AY349367 | clade_54 | N | N |
| *Actinomyces* sp. oral taxon 170 | 89 | AFBL01000010 | clade_54 | N | N |
| *Actinomyces* sp. oral taxon 171 | 90 | AECW01000034 | clade_54 | N | N |
| *Actinomyces urogenitalis* | 95 | ACFH01000038 | clade_54 | N | N |
| *Actinomyces viscosus* | 96 | ACRE01000096 | clade_54 | N | N |
| *Orientia tsutsugamushi* | 1383 | AP008981 | clade_541 | N | OP |
| *Megamonas funiformis* | 1198 | AB300988 | clade_542 | N | N |
| *Megamonas hypermegale* | 1199 | AJ420107 | clade_542 | N | N |
| *Aeromicrobium marinum* | 102 | NR_025681 | clade_544 | N | N |
| *Aeromicrobium* sp. JC14 | 103 | JF824798 | clade_544 | N | N |
| *Luteococcus sanguinis* | 1190 | NR_025507 | clade_544 | N | N |

TABLE 1-continued

List of Operational Taxonomic Units (OTU) with taxonomic assignments made to Genus, Species, and Phylogenetic Clade.

| OTU | SEQ ID Number | Public DB Accession | Clade | Spore Former | Pathogen Status |
|---|---|---|---|---|---|
| Propionibacteriaceae bacterium NML 02_0265 | 1568 | EF599122 | clade_544 | N | N |
| Rhodococcus corynebacterioides | 1622 | X80615 | clade_546 | N | N |
| Rhodococcus erythropolis | 1624 | ACNO01000030 | clade_546 | N | N |
| Rhodococcus fascians | 1625 | NR_037021 | clade_546 | N | N |
| Segniliparus rotundus | 1690 | CP001958 | clade_546 | N | N |
| Segniliparus rugosus | 1691 | ACZI01000025 | clade_546 | N | N |
| Exiguobacterium acetylicum | 878 | FJ970034 | clade_547 | N | N |
| Macrococcus caseolyticus | 1194 | NR_074941 | clade_547 | N | N |
| Streptomyces sp. 1 AIP_2009 | 1890 | FJ176782 | clade_548 | N | N |
| Streptomyces sp. SD 524 | 1892 | EU544234 | clade_548 | N | N |
| Streptomyces sp. SD 528 | 1893 | EU544233 | clade_548 | N | N |
| Streptomyces thermoviolaceus | 1895 | NR_027616 | clade_548 | N | N |
| Borrelia afzelii | 388 | ABCU01000001 | clade_549 | N | OP |
| Borrelia crocidurae | 390 | DQ057990 | clade_549 | N | OP |
| Borrelia duttonii | 391 | NC_011229 | clade_549 | N | OP |
| Borrelia hermsii | 393 | AY597657 | clade_549 | N | OP |
| Borrelia hispanica | 394 | DQ057988 | clade_549 | N | OP |
| Borrelia persica | 395 | HM161645 | clade_549 | N | OP |
| Borrelia recurrentis | 396 | AF107367 | clade_549 | N | OP |
| Borrelia spielmanii | 398 | ABKB01000002 | clade_549 | N | OP |
| Borrelia turicatae | 399 | NC_008710 | clade_549 | N | OP |
| Borrelia valaisiana | 400 | ABCY01000002 | clade_549 | N | OP |
| Providencia alcalifaciens | 1586 | ABXW01000071 | clade_55 | N | N |
| Providencia rettgeri | 1587 | AM040492 | clade_55 | N | N |
| Providencia rustigianii | 1588 | AM040489 | clade_55 | N | N |
| Providencia stuartii | 1589 | AF008581 | clade_55 | N | N |
| Treponema pallidum | 1932 | CP001752 | clade_550 | N | OP |
| Treponema phagedenis | 1934 | AEFH01000172 | clade_550 | N | N |
| Treponema sp. clone DDKL_4 | 1939 | Y08894 | clade_550 | N | N |
| Acholeplasma laidlawii | 17 | NR_074448 | clade_551 | N | N |
| Mycoplasma putrefaciens | 1323 | U26055 | clade_551 | N | N |
| Mycoplasmataceae genomosp. P1 oral clone MB1_G23 | 1325 | DQ003614 | clade_551 | N | N |
| Spiroplasma insolitum | 1750 | NR_025705 | clade_551 | N | N |
| Collinsella intestinalis | 660 | ABXH02000037 | clade_553 | N | N |
| Collinsella stercoris | 661 | ABXJ01000150 | clade_553 | N | N |
| Collinsella tanakaei | 662 | AB490807 | clade_553 | N | N |
| Caminicella sporogenes | 458 | NR_025485 | clade_554 | N | N |
| Acidaminococcus fermentans | 21 | CP001859 | clade_556 | N | N |
| Acidaminococcus intestini | 22 | CP003058 | clade_556 | N | N |
| Acidaminococcus sp. D21 | 23 | ACGB01000071 | clade_556 | N | N |
| Phascolarctobacterium faecium | 1462 | NR_026111 | clade_556 | N | N |
| Phascolarctobacterium sp. YIT 12068 | 1463 | AB490812 | clade_556 | N | N |
| Phascolarctobacterium succinatutens | 1464 | AB490811 | clade_556 | N | N |
| Acidithiobacillus ferrivorans | 25 | NR_074660 | clade_557 | N | N |
| Xanthomonadaceae bacterium NML 03_0222 | 2015 | EU313791 | clade_557 | N | N |
| Catabacter hongkongensis | 494 | AB671763 | clade_558 | N | N |
| Christensenella minuta | 512 | AB490809 | clade_558 | N | N |
| Clostridiales bacterium oral clone P4PA_66 P1 | 536 | AY207065 | clade_558 | N | N |
| Clostridiales bacterium oral taxon 093 | 537 | GQ422712 | clade_558 | N | N |
| Heliobacterium modesticaldum | 1000 | NR_074517 | clade_560 | N | N |
| Alistipes indistinctus | 130 | AB490804 | clade_561 | N | N |
| Bacteroidales bacterium ph8 | 257 | JN837494 | clade_561 | N | N |
| Candidatus Sulcia muelleri | 475 | CP002163 | clade_561 | N | N |
| Cytophaga xylanolytica | 742 | FR733683 | clade_561 | N | N |
| Flavobacteriaceae genomosp. C1 | 884 | AY278614 | clade_561 | N | N |
| Gramella forsetii | 958 | NR_074707 | clade_561 | N | N |
| Sphingobacterium faecium | 1740 | NR_025537 | clade_562 | N | N |
| Sphingobacterium mizutaii | 1741 | JF708889 | clade_562 | N | N |
| Sphingobacterium multivorum | 1742 | NR_040953 | clade_562 | N | N |
| Sphingobacterium spiritivorum | 1743 | ACHA02000013 | clade_562 | N | N |
| Jonquetella anthropi | 1017 | ACOO02000004 | clade_563 | N | N |
| Pyramidobacter piscolens | 1614 | AY207056 | clade_563 | N | N |
| Synergistes genomosp. C1 | 1904 | AY278615 | clade_563 | N | N |
| Synergistes sp. RMA 14551 | 1905 | DQ412722 | clade_563 | N | N |
| Synergistetes bacterium ADV897 | 1906 | GQ258968 | clade_563 | N | N |
| Candidatus Arthromitus sp. SFB_mouse_Yit | 474 | NR_074460 | clade_564 | N | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| *Gracilibacter thermotolerans* | 957 | NR_043559 | clade_564 | N | N |
| *Brachyspira aalborgi* | 404 | FM178386 | clade_565 | N | N |
| *Brachyspira* sp. HIS3 | 406 | FM178387 | clade_565 | N | N |
| *Brachyspira* sp. HIS4 | 407 | FM178388 | clade_565 | N | N |
| *Brachyspira* sp. HIS5 | 408 | FM178389 | clade_565 | N | N |
| *Adlercreutzia equolifaciens* | 97 | AB306661 | clade_566 | N | N |
| Coriobacteriaceae bacterium JC110 | 678 | CAEM01000062 | clade_566 | N | N |
| Coriobacteriaceae bacterium phl | 679 | JN837493 | clade_566 | N | N |
| *Cryptobacterium curtum* | 740 | GQ422741 | clade_566 | N | N |
| *Eggerthella sinensis* | 779 | AY321958 | clade_566 | N | N |
| *Eggerthella* sp. 1_3_56FAA | 780 | ACWN01000099 | clade_566 | N | N |
| *Eggerthella* sp. HGA1 | 781 | AEXR01000021 | clade_566 | N | N |
| *Eggerthella* sp. YY7918 | 782 | AP012211 | clade_566 | N | N |
| *Gordonibacter pamelaeae* | 680 | AM886059 | clade_566 | N | N |
| *Gordonibacter pamelaeae* | 956 | FP929047 | clade_566 | N | N |
| *Slackia equolifaciens* | 1732 | EU377663 | clade_566 | N | N |
| *Slackia exigua* | 1733 | ACUX01000029 | clade_566 | N | N |
| *Slackia faecicanis* | 1734 | NR_042220 | clade_566 | N | N |
| *Slackia heliotrinireducens* | 1735 | NR_074439 | clade_566 | N | N |
| *Slackia isoflavoniconvertens* | 1736 | AB566418 | clade_566 | N | N |
| *Slackia piriformis* | 1737 | AB490806 | clade_566 | N | N |
| *Slackia* sp. NATTS | 1738 | AB505075 | clade_566 | N | N |
| Chlamydiales bacterium NS13 | 506 | JN606075 | clade_567 | N | N |
| Victivallaceae bacterium NML 080035 | 2003 | FJ394915 | clade_567 | N | N |
| *Victivallis vadensis* | 2004 | ABDE02000010 | clade_567 | N | N |
| *Streptomyces griseus* | 1889 | NR_074787 | clade_573 | N | N |
| *Streptomyces* sp. SD 511 | 1891 | EU544231 | clade_573 | N | N |
| *Streptomyces* sp. SD 534 | 1894 | EU544232 | clade_573 | N | N |
| *Cloacibacillus evryensis* | 530 | GQ258966 | clade_575 | N | N |
| *Deferribacteres* sp. oral clone JV001 | 743 | AY349370 | clade_575 | N | N |
| *Deferribacteres* sp. oral clone JV023 | 745 | AY349372 | clade_575 | N | N |
| Synergistetes bacterium LBVCM1157 | 1907 | GQ258969 | clade_575 | N | N |
| Synergistetes bacterium oral taxon 362 | 1909 | GU410752 | clade_575 | N | N |
| Synergistetes bacterium oral taxon D48 | 1910 | GU430992 | clade_575 | N | N |
| *Peptococcus* sp. oral clone JM048 | 1439 | AY349389 | clade_576 | N | N |
| *Helicobacter winghamensis* | 999 | ACDO01000013 | clade_577 | N | N |
| *Wolinella succinogenes* | 2014 | BX571657 | clade_577 | N | N |
| *Olsenella* genomosp. C1 | 1368 | AY278623 | clade_578 | N | N |
| *Olsenella profusa* | 1369 | FN178466 | clade_578 | N | N |
| *Olsenella* sp. F0004 | 1370 | EU592964 | clade_578 | N | N |
| *Olsenella* sp. oral taxon 809 | 1371 | ACVE01000002 | clade_578 | N | N |
| *Olsenella uli* | 1372 | CP002106 | clade_578 | N | N |
| *Nocardiopsis dassonvillei* | 1356 | CP002041 | clade_579 | N | N |
| *Peptococcus niger* | 1438 | NR_029221 | clade_580 | N | N |
| *Peptococcus* sp. oral taxon 167 | 1440 | GQ422727 | clade_580 | N | N |
| *Akkermansia muciniphila* | 118 | CP001071 | clade_583 | N | N |
| *Opitutus terrae* | 1373 | NR_074978 | clade_583 | N | N |
| Clostridiales bacterium oral taxon F32 | 538 | HM099644 | clade_584 | N | N |
| *Leptospira borgpetersenii* | 1161 | NC_008508 | clade_585 | N | OP |
| *Leptospira broomii* | 1162 | NR_043200 | clade_585 | N | OP |
| *Leptospira interrogans* | 1163 | NC_005823 | clade_585 | N | OP |
| *Methanobrevibacter gottschalkii* | 1213 | NR_044789 | clade_587 | N | N |
| *Methanobrevibacter millerae* | 1214 | NR_042785 | clade_587 | N | N |
| *Methanobrevibacter oralis* | 1216 | HE654003 | clade_587 | N | N |
| *Methanobrevibacter thaueri* | 1219 | NR_044787 | clade_587 | N | N |
| *Methanobrevibacter smithii* | 1218 | ABYV02000002 | clade_588 | N | N |
| *Deinococcus radiodurans* | 746 | AE000513 | clade_589 | N | N |
| *Deinococcus* sp. R_43890 | 747 | FR682752 | clade_589 | N | N |
| *Thermus aquaticus* | 1923 | NR_025900 | clade_589 | N | N |
| *Actinomyces* sp. c109 | 81 | AB167239 | clade_590 | N | N |
| Syntrophomonadaceae genomosp. P1 | 1912 | AY341821 | clade_590 | N | N |
| *Anaerobaculum hydrogeniformans* | 141 | ACJX02000009 | clade_591 | N | N |
| *Microcystis aeruginosa* | 1246 | NC_010296 | clade_592 | N | N |
| *Prochlorococcus marinus* | 1567 | CP000551 | clade_592 | N | N |
| *Methanobrevibacter acididurans* | 1208 | NR_028779 | clade_593 | N | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| *Methanobrevibacter arboriphilus* | 1209 | NR_042783 | clade_593 | N | N |
| *Methanobrevibacter curvatus* | 1210 | NR_044796 | clade_593 | N | N |
| *Methanobrevibacter cuticularis* | 1211 | NR_044776 | clade_593 | N | N |
| *Methanobrevibacter filiformis* | 1212 | NR_044801 | clade_593 | N | N |
| *Methanobrevibacter woesei* | 1220 | NR_044788 | clade_593 | N | N |
| *Roseiflexus castenholzii* | 1642 | CP000804 | clade_594 | N | N |
| *Methanobrevibacter olleyae* | 1215 | NR_043024 | clade_595 | N | N |
| *Methanobrevibacter ruminantium* | 1217 | NR_042784 | clade_595 | N | N |
| *Methanobrevibacter wolinii* | 1221 | NR_044790 | clade_595 | N | N |
| *Methanosphaera stadtmanae* | 1222 | AY196684 | clade_595 | N | N |
| *Chloroflexi genomosp.* P1 | 511 | AY331414 | clade_596 | N | N |
| *Halorubrum lipolyticum* | 992 | AB477978 | clade_597 | N | N |
| *Methanobacterium formicicum* | 1207 | NR_025028 | clade_597 | N | N |
| *Acidilobus saccharovorans* | 24 | AY350586 | clade_598 | N | N |
| *Hyperthermus butylicus* | 1006 | CP000493 | clade_598 | N | N |
| *Ignicoccus islandicus* | 1011 | X99562 | clade_598 | N | N |
| *Metallosphaera sedula* | 1206 | D26491 | clade_598 | N | N |
| *Thermofilum pendens* | 1922 | X14835 | clade_598 | N | N |
| *Prevotella melaninogenica* | 1506 | CP002122 | clade_6 | N | N |
| *Prevotella* sp. ICM1 | 1520 | HQ616385 | clade_6 | N | N |
| *Prevotella* sp. oral clone FU048 | 1535 | AY349393 | clade_6 | N | N |
| *Prevotella* sp. oral clone GI030 | 1537 | AY349395 | clade_6 | N | N |
| *Prevotella* sp. SEQ116 | 1526 | JN867246 | clade_6 | N | N |
| *Streptococcus anginosus* | 1787 | AECT01000011 | clade_60 | N | N |
| *Streptococcus milleri* | 1812 | X81023 | clade_60 | N | N |
| *Streptococcus* sp. 16362 | 1829 | JN590019 | clade_60 | N | N |
| *Streptococcus* sp. 69130 | 1832 | X78825 | clade_60 | N | N |
| *Streptococcus* sp. AC15 | 1833 | HQ616356 | clade_60 | N | N |
| *Streptococcus* sp. CM7 | 1839 | HQ616373 | clade_60 | N | N |
| *Streptococcus* sp. OBRC6 | 1847 | HQ616352 | clade_60 | N | N |
| *Burkholderia ambifaria* | 442 | AAUZ01000009 | clade_61 | N | OP |
| *Burkholderia cenocepacia* | 443 | AAHI01000060 | clade_61 | N | OP |
| *Burkholderia cepacia* | 444 | NR_041719 | clade_61 | N | OP |
| *Burkholderia mallei* | 445 | CP000547 | clade_61 | N | Category-B |
| *Burkholderia multivorans* | 446 | NC_010086 | clade_61 | N | OP |
| *Burkholderia oklahomensis* | 447 | DQ108388 | clade_61 | N | OP |
| *Burkholderia pseudomallei* | 448 | CP001408 | clade_61 | N | Category-B |
| *Burkholderia rhizoxinica* | 449 | HQ005410 | clade_61 | N | OP |
| *Burkholderia* sp. 383 | 450 | CP000151 | clade_61 | N | OP |
| *Burkholderia xenovorans* | 451 | U86373 | clade_61 | N | OP |
| *Prevotella buccae* | 1488 | ACRB01000001 | clade_62 | N | N |
| *Prevotella* genomosp. P8 oral clone MB3_P13 | 1498 | DQ003622 | clade_62 | N | N |
| *Prevotella* sp. oral clone FW035 | 1536 | AY349394 | clade_62 | N | N |
| *Prevotella bivia* | 1486 | ADFO01000096 | clade_63 | N | N |
| *Prevotella disiens* | 1494 | AEDO01000026 | clade_64 | N | N |
| *Bacteroides faecis* | 276 | GQ496624 | clade_65 | N | N |
| *Bacteroides fragilis* | 279 | AP006841 | clade_65 | N | N |
| *Bacteroides nordii* | 285 | NR_043017 | clade_65 | N | N |
| *Bacteroides salyersiae* | 292 | EU136690 | clade_65 | N | N |
| *Bacteroides* sp. 1_1_14 | 293 | ACRP01000155 | clade_65 | N | N |
| *Bacteroides* sp. 1_1_6 | 295 | ACIC01000215 | clade_65 | N | N |
| *Bacteroides* sp. 2_1_56FAA | 298 | ACWI01000065 | clade_65 | N | N |
| *Bacteroides* sp. AR29 | 316 | AF139525 | clade_65 | N | N |
| *Bacteroides* sp. B2 | 317 | EU722733 | clade_65 | N | N |
| *Bacteroides thetaiotaomicron* | 328 | NR_074277 | clade_65 | N | N |
| *Actinobacillus minor* | 45 | ACFT01000025 | clade_69 | N | N |
| *Haemophilus parasuis* | 978 | GU226366 | clade_69 | N | N |
| *Vibrio cholerae* | 1996 | AAUR01000095 | clade_71 | N | Category-B |
| *Vibrio fluvialis* | 1997 | X76335 | clade_71 | N | Category-B |
| *Vibrio furnissii* | 1998 | CP002377 | clade_71 | N | Category-B |
| *Vibrio mimicus* | 1999 | ADAF01000001 | clade_71 | N | Category-B |
| *Vibrio parahaemolyticus* | 2000 | AAWQ01000116 | clade_71 | N | Category-B |
| *Vibrio* sp. RC341 | 2001 | ACZT01000024 | clade_71 | N | Category-B |
| *Vibrio vulnificus* | 2002 | AE016796 | clade_71 | N | Category-B |
| *Lactobacillus acidophilus* | 1067 | CP000033 | clade_72 | N | N |
| *Lactobacillus amylolyticus* | 1069 | ADNY01000006 | clade_72 | N | N |
| *Lactobacillus amylovorus* | 1070 | CP002338 | clade_72 | N | N |
| *Lactobacillus crispatus* | 1078 | ACOG01000151 | clade_72 | N | N |
| *Lactobacillus delbrueckii* | 1080 | CP002341 | clade_72 | N | N |
| *Lactobacillus helveticus* | 1088 | ACLM01000202 | clade_72 | N | N |
| *Lactobacillus kalixensis* | 1094 | NR_029083 | clade_72 | N | N |
| *Lactobacillus kefiranofaciens* | 1095 | NR_042440 | clade_72 | N | N |
| *Lactobacillus leichmannii* | 1098 | JX986966 | clade_72 | N | N |

TABLE 1-continued

List of Operational Taxonomic Units (OTU) with taxonomic assignments made to Genus, Species, and Phylogenetic Clade.

| OTU | SEQ ID Number | Public DB Accession | Clade | Spore Former | Pathogen Status |
|---|---|---|---|---|---|
| Lactobacillus sp. 66c | 1120 | FR681900 | clade_72 | N | N |
| Lactobacillus sp. KLDS 1.0701 | 1122 | EU600905 | clade_72 | N | N |
| Lactobacillus sp. KLDS 1.0712 | 1130 | EU600916 | clade_72 | N | N |
| Lactobacillus sp. oral clone HT070 | 1136 | AY349383 | clade_72 | N | N |
| Lactobacillus ultunensis | 1139 | ACGU01000081 | clade_72 | N | N |
| Prevotella intermedia | 1502 | AF414829 | clade_81 | N | N |
| Prevotella nigrescens | 1511 | AFPX01000069 | clade_81 | N | N |
| Prevotella pallens | 1515 | AFPY01000135 | clade_81 | N | N |
| Prevotella sp. oral taxon 310 | 1551 | GQ422737 | clade_81 | N | N |
| Prevotella genomosp. C1 | 1495 | AY278624 | clade_82 | N | N |
| Prevotella sp. CM38 | 1519 | HQ610181 | clade_82 | N | N |
| Prevotella sp. oral taxon 317 | 1552 | ACQH01000158 | clade_82 | N | N |
| Prevotella sp. SG12 | 1527 | GU561343 | clade_82 | N | N |
| Prevotella denticola | 1493 | CP002589 | clade_83 | N | N |
| Prevotella genomosp. P7 oral clone MB2_P31 | 1497 | DQ003620 | clade_83 | N | N |
| Prevotella histicola | 1501 | JN867315 | clade_83 | N | N |
| Prevotella multiformis | 1508 | AEWX01000054 | clade_83 | N | N |
| Prevotella sp. JCM 6330 | 1522 | AB547699 | clade_83 | N | N |
| Prevotella sp. oral clone GI059 | 1539 | AY349397 | clade_83 | N | N |
| Prevotella sp. oral taxon 782 | 1555 | GQ422745 | clade_83 | N | N |
| Prevotella sp. oral taxon G71 | 1559 | GU432180 | clade_83 | N | N |
| Prevotella sp. SEQ065 | 1524 | JN867234 | clade_83 | N | N |
| Prevotella veroralis | 1565 | ACVA01000027 | clade_83 | N | N |
| Bacteroides acidifaciens | 266 | NR_028607 | clade_85 | N | N |
| Bacteroides cellulosilyticus | 269 | ACCH01000108 | clade_85 | N | N |
| Bacteroides clarus | 270 | AFBM01000011 | clade_85 | N | N |
| Bacteroides eggerthii | 275 | ACWG01000065 | clade_85 | N | N |
| Bacteroides oleiciplenus | 286 | AB547644 | clade_85 | N | N |
| Bacteroides pyogenes | 290 | NR_041280 | clade_85 | N | N |
| Bacteroides sp. 315_5 | 300 | FJ848547 | clade_85 | N | N |
| Bacteroides sp. 31SF15 | 301 | AJ583248 | clade_85 | N | N |
| Bacteroides sp. 31SF18 | 302 | AJ583249 | clade_85 | N | N |
| Bacteroides sp. 35AE31 | 303 | AJ583244 | clade_85 | N | N |
| Bacteroides sp. 35AE37 | 304 | AJ583245 | clade_85 | N | N |
| Bacteroides sp. 35BE34 | 305 | AJ583246 | clade_85 | N | N |
| Bacteroides sp. 35BE35 | 306 | AJ583247 | clade_85 | N | N |
| Bacteroides sp. WH2 | 324 | AY895180 | clade_85 | N | N |
| Bacteroides sp. XB12B | 325 | AM230648 | clade_85 | N | N |
| Bacteroides stercoris | 327 | ABFZ02000022 | clade_85 | N | N |
| Actinobacillus pleuropneumoniae | 46 | NR_074857 | clade_88 | N | N |
| Actinobacillus ureae | 48 | AEVG01000167 | clade_88 | N | N |
| Haemophilus aegyptius | 969 | AFBC01000053 | clade_88 | N | N |
| Haemophilus ducreyi | 970 | AE017143 | clade_88 | N | OP |
| Haemophilus haemolyticus | 973 | JN175335 | clade_88 | N | N |
| Haemophilus influenzae | 974 | AADP01000001 | clade_88 | N | OP |
| Haemophilus parahaemolyticus | 975 | GU561425 | clade_88 | N | N |
| Haemophilus parainfluenzae | 976 | AEWU01000024 | clade_88 | N | N |
| Haemophilus paraphrophaemolyticus | 977 | M75076 | clade_88 | N | N |
| Haemophilus somnus | 979 | NC_008309 | clade_88 | N | N |
| Haemophilus sp. 70334 | 980 | HQ680854 | clade_88 | N | N |
| Haemophilus sp. HK445 | 981 | FJ685624 | clade_88 | N | N |
| Haemophilus sp. oral clone ASCA07 | 982 | AY923117 | clade_88 | N | N |
| Haemophilus sp. oral clone ASCG06 | 983 | AY923147 | clade_88 | N | N |
| Haemophilus sp. oral clone BJ021 | 984 | AY005034 | clade_88 | N | N |
| Haemophilus sp. oral clone BJ095 | 985 | AY005033 | clade_88 | N | N |
| Haemophilus sp. oral taxon 851 | 987 | AGRK01000004 | clade_88 | N | N |
| Haemophilus sputorum | 988 | AFNK01000005 | clade_88 | N | N |
| Histophilus somni | 1003 | AF549387 | clade_88 | N | N |
| Mannheimia haemolytica | 1195 | ACZX01000102 | clade_88 | N | N |
| Pasteurella bettyae | 1433 | L06088 | clade_88 | N | N |
| Moellerella wisconsensis | 1253 | JN175344 | clade_89 | N | N |
| Morganella morganii | 1265 | AJ301681 | clade_89 | N | N |
| Morganella sp. JB_T16 | 1266 | AJ781005 | clade_89 | N | N |
| Proteus mirabilis | 1582 | ACLE01000013 | clade_89 | N | N |
| Proteus penneri | 1583 | ABVP01000020 | clade_89 | N | N |
| Proteus sp. HS7514 | 1584 | DQ512963 | clade_89 | N | N |
| Proteus vulgaris | 1585 | AJ233425 | clade_89 | N | N |
| Oribacterium sinus | 1374 | ACKX01000142 | clade_90 | N | N |
| Oribacterium sp. ACB1 | 1375 | HM120210 | clade_90 | N | N |
| Oribacterium sp. ACB7 | 1376 | HM120211 | clade_90 | N | N |

TABLE 1-continued

List of Operational Taxonomic Units (OTU) with taxonomic assignments made to Genus, Species, and Phylogenetic Clade.

| OTU | SEQ ID Number | Public DB Accession | Clade | Spore Former | Pathogen Status |
|---|---|---|---|---|---|
| Oribacterium sp. CM12 | 1377 | HQ616374 | clade_90 | N | N |
| Oribacterium sp. ICM51 | 1378 | HQ616397 | clade_90 | N | N |
| Oribacterium sp. OBRC12 | 1379 | HQ616355 | clade_90 | N | N |
| Oribacterium sp. oral taxon 108 | 1382 | AFIH01000001 | clade_90 | N | N |
| Actinobacillus actinomycetemcomitans | 44 | AY362885 | clade_92 | N | N |
| Actinobacillus succinogenes | 47 | CP000746 | clade_92 | N | N |
| Aggregatibacter actinomycetemcomitans | 112 | CP001733 | clade_92 | N | N |
| Aggregatibacter aphrophilus | 113 | CP001607 | clade_92 | N | N |
| Aggregatibacter segnis | 114 | AEPS01000017 | clade_92 | N | N |
| Averyella dalhousiensis | 194 | DQ481464 | clade_92 | N | N |
| Bisgaard Taxon | 368 | AY683487 | clade_92 | N | N |
| Bisgaard Taxon | 369 | AY683489 | clade_92 | N | N |
| Bisgaard Taxon | 370 | AY683491 | clade_92 | N | N |
| Bisgaard Taxon | 371 | AY683492 | clade_92 | N | N |
| Buchnera aphidicola | 440 | NR_074609 | clade_92 | N | N |
| Cedecea davisae | 499 | AF493976 | clade_92 | N | N |
| Citrobacter amalonaticus | 517 | FR870441 | clade_92 | N | N |
| Citrobacter braakii | 518 | NR_028687 | clade_92 | N | N |
| Citrobacter farmeri | 519 | AF025371 | clade_92 | N | N |
| Citrobacter freundii | 520 | NR_028894 | clade_92 | N | N |
| Citrobacter gillenii | 521 | AF025367 | clade_92 | N | N |
| Citrobacter koseri | 522 | NC_009792 | clade_92 | N | N |
| Citrobacter murliniae | 523 | AF025369 | clade_92 | N | N |
| Citrobacter rodentium | 524 | NR_074903 | clade_92 | N | N |
| Citrobacter sedlakii | 525 | AF025364 | clade_92 | N | N |
| Citrobacter sp. 30_2 | 526 | ACDJ01000053 | clade_92 | N | N |
| Citrobacter sp. KMSI_3 | 527 | GQ468398 | clade_92 | N | N |
| Citrobacter werkmanii | 528 | AF025373 | clade_92 | N | N |
| Citrobacter youngae | 529 | ABWL02000011 | clade_92 | N | N |
| Cronobacter malonaticus | 737 | GU122174 | clade_92 | N | N |
| Cronobacter sakazakii | 738 | NC_009778 | clade_92 | N | N |
| Cronobacter turicensis | 739 | FN543093 | clade_92 | N | N |
| Enterobacter aerogenes | 786 | AJ251468 | clade_92 | N | N |
| Enterobacter asburiae | 787 | NR_024640 | clade_92 | N | N |
| Enterobacter cancerogenus | 788 | Z96078 | clade_92 | N | N |
| Enterobacter cloacae | 789 | FP929040 | clade_92 | N | N |
| Enterobacter cowanii | 790 | NR_025566 | clade_92 | N | N |
| Enterobacter hormaechei | 791 | AFHR01000079 | clade_92 | N | N |
| Enterobacter sp. 247BMC | 792 | HQ122932 | clade_92 | N | N |
| Enterobacter sp. 638 | 793 | NR_074777 | clade_92 | N | N |
| Enterobacter sp. JC163 | 794 | JN657217 | clade_92 | N | N |
| Enterobacter sp. SCSS | 795 | HM007811 | clade_92 | N | N |
| Enterobacter sp. TSE38 | 796 | HM156134 | clade_92 | N | N |
| Enterobacteriaceae bacterium 9_2_54FAA | 797 | ADCU01000033 | clade_92 | N | N |
| Enterobacteriaceae bacterium CF01Ent_1 | 798 | AJ489826 | clade_92 | N | N |
| Enterobacteriaceae bacterium Smarlab 3302238 | 799 | AY538694 | clade_92 | N | N |
| Escherichia albertii | 824 | ABKX01000012 | clade_92 | N | N |
| Escherichia coli | 825 | NC_008563 | clade_92 | N | Category-B |
| Escherichia fergusonii | 826 | CU928158 | clade_92 | N | N |
| Escherichia hermannii | 827 | HQ407266 | clade_92 | N | N |
| Escherichia sp. 1_1_43 | 828 | ACID01000033 | clade_92 | N | N |
| Escherichia sp. 4_1_40B | 829 | ACDM02000056 | clade_92 | N | N |
| Escherichia sp. B4 | 830 | EU722735 | clade_92 | N | N |
| Escherichia vulneris | 831 | NR_041927 | clade_92 | N | N |
| Ewingella americana | 877 | JN175329 | clade_92 | N | N |
| Haemophilus genomosp. P2 oral clone MB3_C24 | 971 | DQ003621 | clade_92 | N | N |
| Haemophilus genomosp. P3 oral clone MB3_C38 | 972 | DQ003635 | clade_92 | N | N |
| Haemophilus sp. oral clone JM053 | 986 | AY349380 | clade_92 | N | N |
| Hafnia alvei | 989 | DQ412565 | clade_92 | N | N |
| Klebsiella oxytoca | 1024 | AY292871 | clade_92 | N | OP |
| Klebsiella pneumoniae | 1025 | CP000647 | clade_92 | N | OP |
| Klebsiella sp. AS10 | 1026 | HQ616362 | clade_92 | N | N |
| Klebsiella sp. Co9935 | 1027 | DQ068764 | clade_92 | N | N |
| Klebsiella sp. enrichment culture clone SRC_DSD25 | 1036 | HM195210 | clade_92 | N | N |
| Klebsiella sp. OBRC7 | 1028 | HQ616353 | clade_92 | N | N |
| Klebsiella sp. SP_BA | 1029 | FJ999767 | clade_92 | N | N |

TABLE 1-continued

List of Operational Taxonomic Units (OTU) with taxonomic assignments made to Genus, Species, and Phylogenetic Clade.

| OTU | SEQ ID Number | Public DB Accession | Clade | Spore Former | Pathogen Status |
|---|---|---|---|---|---|
| *Klebsiella* sp. SRC_DSD1 | 1033 | GU797254 | clade_92 | N | N |
| *Klebsiella* sp. SRC_DSD11 | 1030 | GU797263 | clade_92 | N | N |
| *Klebsiella* sp. SRC_DSD12 | 1031 | GU797264 | clade_92 | N | N |
| *Klebsiella* sp. SRC_DSD15 | 1032 | GU797267 | clade_92 | N | N |
| *Klebsiella* sp. SRC_DSD2 | 1034 | GU797253 | clade_92 | N | N |
| *Klebsiella* sp. SRC_DSD6 | 1035 | GU797258 | clade_92 | N | N |
| *Klebsiella variicola* | 1037 | CP001891 | clade_92 | N | N |
| *Kluyvera ascorbata* | 1038 | NR_028677 | clade_92 | N | N |
| *Kluyvera cryocrescens* | 1039 | NR_028803 | clade_92 | N | N |
| *Leminorella grimontii* | 1159 | AJ233421 | clade_92 | N | N |
| *Leminorella richardii* | 1160 | HF558368 | clade_92 | N | N |
| *Pantoea agglomerans* | 1409 | AY335552 | clade_92 | N | N |
| *Pantoea ananatis* | 1410 | CP001875 | clade_92 | N | N |
| *Pantoea brenneri* | 1411 | EU216735 | clade_92 | N | N |
| *Pantoea citrea* | 1412 | EF688008 | clade_92 | N | N |
| *Pantoea conspicua* | 1413 | EU216737 | clade_92 | N | N |
| *Pantoea septica* | 1414 | EU216734 | clade_92 | N | N |
| *Pasteurella dagmatis* | 1434 | ACZR01000003 | clade_92 | N | N |
| *Pasteurella multocida* | 1435 | NC_002663 | clade_92 | N | N |
| *Plesiomonas shigelloides* | 1469 | X60418 | clade_92 | N | N |
| *Raoultella ornithinolytica* | 1617 | AB364958 | clade_92 | N | N |
| *Raoultella planticola* | 1618 | AF129443 | clade_92 | N | N |
| *Raoultella terrigena* | 1619 | NR_037085 | clade_92 | N | N |
| *Salmonella bongori* | 1683 | NR_041699 | clade_92 | N | Category-B |
| *Salmonella enterica* | 1672 | NC_011149 | clade_92 | N | Category-B |
| *Salmonella enterica* | 1673 | NC_011205 | clade_92 | N | Category-B |
| *Salmonella enterica* | 1674 | DQ344532 | clade_92 | N | Category-B |
| *Salmonella enterica* | 1675 | ABEH02000004 | clade_92 | N | Category-B |
| *Salmonella enterica* | 1676 | ABAK02000001 | clade_92 | N | Category-B |
| *Salmonella enterica* | 1677 | NC_011080 | clade_92 | N | Category-B |
| *Salmonella enterica* | 1678 | EU118094 | clade_92 | N | Category-B |
| *Salmonella enterica* | 1679 | NC_011094 | clade_92 | N | Category-B |
| *Salmonella enterica* | 1680 | AE014613 | clade_92 | N | Category-B |
| *Salmonella enterica* | 1682 | ABFH02000001 | clade_92 | N | Category-B |
| *Salmonella enterica* | 1684 | ABEM01000001 | clade_92 | N | Category-B |
| *Salmonella enterica* | 1685 | ABAM02000001 | clade_92 | N | Category-B |
| *Salmonella typhimurium* | 1681 | DQ344533 | clade_92 | N | Category-B |
| *Salmonella typhimurium* | 1686 | AF170176 | clade_92 | N | Category-B |
| *Serratia fonticola* | 1718 | NR_025339 | clade_92 | N | N |
| *Serratia liquefaciens* | 1719 | NR_042062 | clade_92 | N | N |
| *Serratia marcescens* | 1720 | GU826157 | clade_92 | N | N |
| *Serratia odorifera* | 1721 | ADBY01000001 | clade_92 | N | N |
| *Serratia proteamaculans* | 1722 | AAUN01000015 | clade_92 | N | N |
| *Shigella boydii* | 1724 | AAKA01000007 | clade_92 | N | Category-B |
| *Shigella dysenteriae* | 1725 | NC_007606 | clade_92 | N | Category-B |
| *Shigella flexneri* | 1726 | AE005674 | clade_92 | N | Category-B |
| *Shigella sonnei* | 1727 | NC_007384 | clade_92 | N | Category-B |
| *Tatumella ptyseos* | 1916 | NR_025342 | clade_92 | N | N |
| *Trabulsiella guamensis* | 1925 | AY373830 | clade_92 | N | N |
| *Yersinia aldovae* | 2019 | AJ871363 | clade_92 | N | OP |
| *Yersinia aleksiciae* | 2020 | AJ627597 | clade_92 | N | OP |
| *Yersinia bercovieri* | 2021 | AF366377 | clade_92 | N | OP |
| *Yersinia enterocolitica* | 2022 | FR729477 | clade_92 | N | Category-B |
| *Yersinia frederiksenii* | 2023 | AF366379 | clade_92 | N | OP |
| *Yersinia intermedia* | 2024 | AF366380 | clade_92 | N | OP |
| *Yersinia kristensenii* | 2025 | ACCA01000078 | clade_92 | N | OP |
| *Yersinia mollaretii* | 2026 | NR_027546 | clade_92 | N | OP |
| *Yersinia pestis* | 2027 | AE013632 | clade_92 | N | Category-A |
| *Yersinia pseudotuberculosis* | 2028 | NC_009708 | clade_92 | N | OP |
| *Yersinia rohdei* | 2029 | ACCD01000071 | clade_92 | N | OP |
| *Yokenella regensburgei* | 2030 | AB273739 | clade_92 | N | N |
| *Conchiformibius kuhniae* | 669 | NR_041821 | clade_94 | N | N |
| *Morococcus cerebrosus* | 1267 | JN175352 | clade_94 | N | N |
| *Neisseria bacilliformis* | 1328 | AFAY01000058 | clade_94 | N | N |
| *Neisseria cinerea* | 1329 | ACDY01000037 | clade_94 | N | N |
| *Neisseria flavescens* | 1331 | ACQV01000025 | clade_94 | N | N |
| *Neisseria gonorrhoeae* | 1333 | CP002440 | clade_94 | N | OP |
| *Neisseria lactamica* | 1334 | ACEQ01000095 | clade_94 | N | N |
| *Neisseria macacae* | 1335 | AFQE01000146 | clade_94 | N | N |
| *Neisseria meningitidis* | 1336 | NC_003112 | clade_94 | N | OP |
| *Neisseria mucosa* | 1337 | ACDX01000110 | clade_94 | N | N |
| *Neisseria pharyngis* | 1338 | AJ239281 | clade_94 | N | N |
| *Neisseria polysaccharea* | 1339 | ADBE01000137 | clade_94 | N | N |
| *Neisseria sicca* | 1340 | ACKO02000016 | clade_94 | N | N |

TABLE 1-continued

List of Operational Taxonomic Units (OTU) with taxonomic assignments made to Genus, Species, and Phylogenetic Clade.

| OTU | SEQ ID Number | Public DB Accession | Clade | Spore Former | Pathogen Status |
|---|---|---|---|---|---|
| *Neisseria* sp. KEM232 | 1341 | GQ203291 | clade_94 | N | N |
| *Neisseria* sp. oral clone AP132 | 1344 | AY005027 | clade_94 | N | N |
| *Neisseria* sp. oral strain B33KA | 1346 | AY005028 | clade_94 | N | N |
| *Neisseria* sp. oral taxon 014 | 1347 | ADEA01000039 | clade_94 | N | N |
| *Neisseria* sp. TM10_1 | 1343 | DQ279352 | clade_94 | N | N |
| *Neisseria subflava* | 1348 | ACEO01000067 | clade_94 | N | N |
| *Okadaella gastrococcus* | 1365 | HQ699465 | clade_98 | N | N |
| *Streptococcus agalactiae* | 1785 | AAJO01000130 | clade_98 | N | N |
| *Streptococcus alactolyticus* | 1786 | NR_041781 | clade_98 | N | N |
| *Streptococcus australis* | 1788 | AEQR01000024 | clade_98 | N | N |
| *Streptococcus bovis* | 1789 | AEEL01000030 | clade_98 | N | N |
| *Streptococcus canis* | 1790 | AJ413203 | clade_98 | N | N |
| *Streptococcus constellatus* | 1791 | AY277942 | clade_98 | N | N |
| *Streptococcus cristatus* | 1792 | AEVC01000028 | clade_98 | N | N |
| *Streptococcus dysgalactiae* | 1794 | AP010935 | clade_98 | N | N |
| *Streptococcus equi* | 1795 | CP001129 | clade_98 | N | N |
| *Streptococcus equinus* | 1796 | AEVB01000043 | clade_98 | N | N |
| *Streptococcus gallolyticus* | 1797 | FR824043 | clade_98 | N | N |
| *Streptococcus* genomosp. C1 | 1798 | AY278629 | clade_98 | N | N |
| *Streptococcus* genomosp. C2 | 1799 | AY278630 | clade_98 | N | N |
| *Streptococcus* genomosp. C3 | 1800 | AY278631 | clade_98 | N | N |
| *Streptococcus* genomosp. C4 | 1801 | AY278632 | clade_98 | N | N |
| *Streptococcus* genomosp. C5 | 1802 | AY278633 | clade_98 | N | N |
| *Streptococcus* genomosp. C6 | 1803 | AY278634 | clade_98 | N | N |
| *Streptococcus* genomosp. C7 | 1804 | AY278635 | clade_98 | N | N |
| *Streptococcus* genomosp. C8 | 1805 | AY278609 | clade_98 | N | N |
| *Streptococcus gordonii* | 1806 | NC_009785 | clade_98 | N | N |
| *Streptococcus infantarius* | 1807 | ABJK02000017 | clade_98 | N | N |
| *Streptococcus infantis* | 1808 | AFNN01000024 | clade_98 | N | N |
| *Streptococcus intermedius* | 1809 | NR_028736 | clade_98 | N | N |
| *Streptococcus lutetiensis* | 1810 | NR_037096 | clade_98 | N | N |
| *Streptococcus massiliensis* | 1811 | AY769997 | clade_98 | N | N |
| *Streptococcus mitis* | 1813 | AM157420 | clade_98 | N | N |
| *Streptococcus oligofermentans* | 1815 | AY099095 | clade_98 | N | N |
| *Streptococcus oralis* | 1816 | ADMV01000001 | clade_98 | N | N |
| *Streptococcus parasanguinis* | 1817 | AEKM01000012 | clade_98 | N | N |
| *Streptococcus pasteurianus* | 1818 | AP012054 | clade_98 | N | N |
| *Streptococcus peroris* | 1819 | AEVF01000016 | clade_98 | N | N |
| *Streptococcus pneumoniae* | 1820 | AE008537 | clade_98 | N | N |
| *Streptococcus porcinus* | 1821 | EF121439 | clade_98 | N | N |
| *Streptococcus pseudopneumoniae* | 1822 | FJ827123 | clade_98 | N | N |
| *Streptococcus pseudoporcinus* | 1823 | AENS01000003 | clade_98 | N | N |
| *Streptococcus pyogenes* | 1824 | AE006496 | clade_98 | N | OP |
| *Streptococcus ratti* | 1825 | X58304 | clade_98 | N | N |
| *Streptococcus sanguinis* | 1827 | NR_074974 | clade_98 | N | N |
| *Streptococcus sinensis* | 1828 | AF432857 | clade_98 | N | N |
| *Streptococcus* sp. 2_1_36FAA | 1831 | ACOI01000028 | clade_98 | N | N |
| *Streptococcus* sp. 2285_97 | 1830 | AJ131965 | clade_98 | N | N |
| *Streptococcus* sp. ACS2 | 1834 | HQ616360 | clade_98 | N | N |
| *Streptococcus* sp. AS20 | 1835 | HQ616366 | clade_98 | N | N |
| *Streptococcus* sp. BS35a | 1836 | HQ616369 | clade_98 | N | N |
| *Streptococcus* sp. C150 | 1837 | ACRI01000045 | clade_98 | N | N |
| *Streptococcus* sp. CM6 | 1838 | HQ616372 | clade_98 | N | N |
| *Streptococcus* sp. ICM10 | 1840 | HQ616389 | clade_98 | N | N |
| *Streptococcus* sp. ICM12 | 1841 | HQ616390 | clade_98 | N | N |
| *Streptococcus* sp. ICM2 | 1842 | HQ616386 | clade_98 | N | N |
| *Streptococcus* sp. ICM4 | 1844 | HQ616387 | clade_98 | N | N |
| *Streptococcus* sp. ICM45 | 1843 | HQ616394 | clade_98 | N | N |
| *Streptococcus* sp. M143 | 1845 | ACRK01000025 | clade_98 | N | N |
| *Streptococcus* sp. M334 | 1846 | ACRL01000052 | clade_98 | N | N |
| *Streptococcus* sp. oral clone ASB02 | 1849 | AY923121 | clade_98 | N | N |
| *Streptococcus* sp. oral clone ASCA03 | 1850 | DQ272504 | clade_98 | N | N |
| *Streptococcus* sp. oral clone ASCA04 | 1851 | AY923116 | clade_98 | N | N |
| *Streptococcus* sp. oral clone ASCA09 | 1852 | AY923119 | clade_98 | N | N |
| *Streptococcus* sp. oral clone ASCB04 | 1853 | AY923123 | clade_98 | N | N |
| *Streptococcus* sp. oral clone ASCB06 | 1854 | AY923124 | clade_98 | N | N |
| *Streptococcus* sp. oral clone ASCC04 | 1855 | AY923127 | clade_98 | N | N |

TABLE 1-continued

List of Operational Taxonomic Units (OTU) with taxonomic
assignments made to Genus, Species, and Phylogenetic Clade.

| OTU | SEQ ID Number | Public DB Accession | Clade | Spore Former | Pathogen Status |
|---|---|---|---|---|---|
| *Streptococcus* sp. oral clone ASCC05 | 1856 | AY923128 | clade_98 | N | N |
| *Streptococcus* sp. oral clone ASCC12 | 1857 | DQ272507 | clade_98 | N | N |
| *Streptococcus* sp. oral clone ASCD01 | 1858 | AY923129 | clade_98 | N | N |
| *Streptococcus* sp. oral clone ASCD09 | 1859 | AY923130 | clade_98 | N | N |
| *Streptococcus* sp. oral clone ASCD10 | 1860 | DQ272509 | clade_98 | N | N |
| *Streptococcus* sp. oral clone ASCE03 | 1861 | AY923134 | clade_98 | N | N |
| *Streptococcus* sp. oral clone ASCE04 | 1862 | AY953253 | clade_98 | N | N |
| *Streptococcus* sp. oral clone ASCE05 | 1863 | DQ272510 | clade_98 | N | N |
| *Streptococcus* sp. oral clone ASCE06 | 1864 | AY923135 | clade_98 | N | N |
| *Streptococcus* sp. oral clone ASCE09 | 1865 | AY923136 | clade_98 | N | N |
| *Streptococcus* sp. oral clone ASCE10 | 1866 | AY923137 | clade_98 | N | N |
| *Streptococcus* sp. oral clone ASCE12 | 1867 | AY923138 | clade_98 | N | N |
| *Streptococcus* sp. oral clone ASCF05 | 1868 | AY923140 | clade_98 | N | N |
| *Streptococcus* sp. oral clone ASCF07 | 1869 | AY953255 | clade_98 | N | N |
| *Streptococcus* sp. oral clone ASCF09 | 1870 | AY923142 | clade_98 | N | N |
| *Streptococcus* sp. oral clone ASCG04 | 1871 | AY923145 | clade_98 | N | N |
| *Streptococcus* sp. oral clone BW009 | 1872 | AY005042 | clade_98 | N | N |
| *Streptococcus* sp. oral clone CH016 | 1873 | AY005044 | clade_98 | N | N |
| *Streptococcus* sp. oral clone GK051 | 1874 | AY349413 | clade_98 | N | N |
| *Streptococcus* sp. oral clone GM006 | 1875 | AY349414 | clade_98 | N | N |
| *Streptococcus* sp. oral clone P2PA_41 P2 | 1876 | AY207051 | clade_98 | N | N |
| *Streptococcus* sp. oral clone P4PA_30 P4 | 1877 | AY207064 | clade_98 | N | N |
| *Streptococcus* sp. oral taxon 071 | 1878 | AEEP01000019 | clade_98 | N | N |
| *Streptococcus* sp. oral taxon G59 | 1879 | GU432132 | clade_98 | N | N |
| *Streptococcus* sp. oral taxon G62 | 1880 | GU432146 | clade_98 | N | N |
| *Streptococcus* sp. oral taxon G63 | 1881 | GU432150 | clade_98 | N | N |
| *Streptococcus suis* | 1882 | FM252032 | clade_98 | N | N |
| *Streptococcus thermophilus* | 1883 | CP000419 | clade_98 | N | N |
| *Streptococcus salivarius* | 1826 | AGBV01000001 | clade_98 | N | N |
| *Streptococcus uberis* | 1884 | HQ391900 | clade_98 | N | N |
| *Streptococcus urinalis* | 1885 | DQ303194 | clade_98 | N | N |
| *Streptococcus vestibularis* | 1886 | AEKO01000008 | clade_98 | N | N |
| *Streptococcus viridans* | 1887 | AF076036 | clade_98 | N | N |
| Synergistetes bacterium oral clone 03 5 D05 | 1908 | GU227192 | clade_98 | N | N |

Clade membership of bacterial OTUs is based on 16S sequence data. Clades are defined based on the topology of a phylogenetic tree that is constructed from full-length 16S sequences using maximum likelihood methods familiar to individuals with ordinary skill in the art of phylogenetics. Clades are constructed to ensure that all OTUs in a given clade are: (i) within a specified number of bootstrap supported nodes from one another, and (ii) within 5% genetic similarity. OTUs that are within the same clade can be distinguished as genetically and phylogenetically distinct from OTUs in a different clade based on 16S-V4 sequence data, while OTUs falling within the same clade are closely related. OTUs falling within the same clade are evolutionarily closely related and may or may not be distinguishable from one another using 16S-V4 sequence data. Members of the same clade, due to their evolutionary relatedness, play similar functional roles in a microbial ecology such as that found in the human gut. Compositions substituting one species with another from the same clade are likely to have conserved ecological function and therefore are useful in the present invention. All OTUs are denoted as to their putative capacity to form spores and whether they are a Pathogen or Pathobiont (see Definitions for description of "Pathobiont"). NIAID Priority Pathogens are denoted as 'Category-A', 'Category-B', or 'Category-C', and Opportunistic Pathogens are denoted as 'OP'. OTUs that are not pathogenic or for which their ability to exist as a pathogen is unknown are denoted as 'N'. The 'SEQ ID Number' denotes the identifier of the OTU in the Sequence Listing File and 'Public DB Accession' denotes the identifier of the OTU in a public sequence repository.

TABLE 2

Mouse studies with bacterial compositions

| | Mortality Score | D3 Weight Score | Morbidity >3 Score | Summary Score |
|---|---|---|---|---|
| Treatment 1 | 3 | 3.0 | 3.0 | 9 |
| Treatment 2 | 0 | 0.6 | 0.0 | 1 |
| Treatment 3 | 0 | −0.5 | 0.0 | −1 |
| Treatment 4 | 0.5 | 2.4 | 0.6 | 3 |
| Treatment 5 | 0 | 0.5 | 0.0 | 0 |
| Treatment 6 | 1 | 2.0 | 0.6 | 4 |
| Treatment 7 | 0.5 | 0.7 | 0.4 | 2 |
| Treatment 8 | 0 | 0.6 | 0.0 | 1 |
| Treatment 9 | 0.5 | 1.3 | 0.6 | 2 |
| Treatment 10 | 0.5 | 1.5 | 0.6 | 3 |
| Treatment 11 | 0.5 | 1.0 | 0.6 | 2 |
| Treatment 12 | 0 | 1.3 | 0.0 | 1 |
| Treatment 13 | 0.5 | 1.3 | 0.4 | 2 |
| Treatment 14 | 0.5 | 1.2 | 0.6 | 2 |

TABLE 3A

Table 3A. Mouse studies with bacterial compositions

| | Mortality Score | D3 Weight Score | Morbidity >3 Score | Summary Score |
|---|---|---|---|---|
| Treatment 1 | 3 | 3.0 | 3.0 | 9 |
| Treatment 2 | 0 | 0.0 | 0.0 | 0 |
| Treatment 3 | 3 | 2.1 | 2.7 | 8 |
| Treatment 4 | 1.5 | 1.1 | 1.1 | 4 |
| Treatment 5 | 0 | 0.7 | 0.2 | 1 |
| Treatment 6 | 0 | 1.2 | 0.0 | 1 |
| Treatment 7 | 3 | 2.4 | 2.1 | 8 |
| Treatment 8 | 0 | 0.8 | 0.6 | 1 |
| Treatment 9 | 0 | 0.9 | 0.3 | 1 |
| Treatment 10 | 1.5 | 2.5 | 2.7 | 7 |
| Treatment 11 | 0 | 1.3 | 0.8 | 2 |
| Treatment 12 | 0 | 0.1 | 0.0 | 0 |
| Treatment 13 | 3 | 1.6 | 0.3 | 5 |
| Treatment 14 | 0 | 0.4 | 2.3 | 3 |
| Treatment 15 | 1.5 | 3.4 | 2.6 | 7 |

TABLE 3B

Table 3B. Mouse studies with bacterial compositions

| | Mortality Score | D3 Weight Score | Morbidity >3 Score | Summary Score |
|---|---|---|---|---|
| Treatment 1 | 3 | 3.0 | 3.0 | 9 |
| Treatment 2 | 1.8 | 0.7 | 2.1 | 5 |
| Treatment 3 | 0 | 0.0 | 0.0 | 0 |
| Treatment 4 | 0 | 0.5 | 0.0 | 0 |
| Treatment 5 | 0 | 0.7 | 0.0 | 1 |
| Treatment 6 | 0.6 | 2.3 | 0.7 | 4 |
| Treatment 7 | 0.6 | 1.7 | 0.6 | 3 |
| Treatment 8 | 2.4 | 3.0 | 2.0 | 7 |
| Treatment 9 | 0.6 | 1.4 | 0.6 | 3 |
| Treatment 10 | 0 | 1.1 | 0.0 | 1 |
| Treatment 11 | 0 | 1.7 | 0.6 | 2 |
| Treatment 12 | 3 | 3.1 | 3.2 | 9 |

TABLE 4

Table 4: Species isolated from ethanol treated spore preparation preparation before (left) and after (right) CsCl gradient step

| Isolates | ethanol treated spore preparation | ethanol treated, gradient purified spore preparation |
|---|---|---|
| *Bacillus coagulans* | 7 | 2 |
| *Blautia luti* | 1 | 1 |
| *Blautia* sp | 14 | 13 |
| *Blautia wexlerae* | 3 | 1 |
| *Ruminococcus obeum* | 4 | 2 |
| *Clostridiales* sp | 1 | 2 |
| *Clostridium aerotolerans* | 1 | 2 |
| *Clostridium disporicum* | 0 | 1 |
| *Clostridium* sp | 1 | 1 |
| *Clostridium symbiosum* | 0 | 1 |
| *Dorea longicatena* | 8 | 6 |
| *Eubacterium cellulosolvens* | 1 | 0 |
| *Eubacterium ventriosum* | 2 | 2 |
| *Gemmiger formicilis* | 0 | 1 |
| *Robinsoniella peoriensis* | 0 | 1 |
| *Roseburia hominis* | 3 | 6 |
| *Roseburia intestinalis* | 9 | 7 |
| *Ruminococcus* sp | 5 | 2 |
| *Syntrophococcus sucromutans* | 1 | 1 |
| *Turicibacter sanguinis* | 3 | 4 |
| *Clostridiales* sp | 7 | 9 |
| *Clostridium bartlettii* | 8 | 11 |
| *Clostridium irregulare* | 0 | 1 |
| *Clostridium sordellii* | 4 | 6 |
| *Lachnospiraceae* sp | 1 | 0 |

TABLE 5

Mortality and weight change in mice challenged with *C. difficile* with or without ethanol treated, spore preparation treatment.

| Test article | mortality (n = 10) | % weight change on Day 3 |
|---|---|---|
| vehicle (negative control) | 20% | −10.5% |
| Donor feces (positive control) | 0 | −0.1% |
| EtOH-treated spore preparation 1x | 0 | 2.3% |
| EtOH-treated spore preparation 0.1x | 0 | 2.4% |
| EtOH-treated spore preparation 0.01x | 0 | −3% |
| heat-treated spore preparation | 0 | 0.1% |

TABLE 6

Table 6 shows spore quantitation for ethanol treated spore preparations using spore CFU (SCFU) assay and DPA assay.

| Preparation | SCFU/30 capsules | DPA SEq/30 capsules | Ratio SCFU/DPA |
|---|---|---|---|
| Preparation 1 | $4.0 \times 10^5$ | $6.8 \times 10^7$ | $5.9 \times 10^{-3}$ |
| Preparation 2 | $2.1 \times 10^7$ | $9.2 \times 10^8$ | 0.023 |
| Preparation 3 | $6.9 \times 10^9$ | $9.6 \times 10^9$ | 0.72 |

Table 6 shows spore quantitation for ethanol treated spore preparations using spore CFU (SCFU) assay and DPA assay.

TABLE 7

DPA doses in Table 7 when normalized to 4 × 10$^5$ SCFU per dose

| Preparation | SCFU/30 capsules | DPA SEq/30 capsules | Fraction of Preparation 1 Dose |
|---|---|---|---|
| Preparation 1 | 4.0 × 10$^5$ | 6.8 × 10$^7$ | 1.0 |
| Preparation 2 | 4.0 × 10$^5$ | 1.8 × 10$^7$ | 0.26 |
| Preparation 3 | 4.0 × 10$^5$ | 5.6 × 10$^5$ | 0.0082 |

TABLE 8

| SPC1 | SPC2 | SPC3 | OTU1 | OTU2 | OTU3 | Results |
|---|---|---|---|---|---|---|
| SPC10325 | SPC10415 | SPC10567 | Clostridium_bolteae | *Blautia producta* | Eubacterium_rectale | ++++ |
| SPC10325 | SPC10355 | SPC10415 | Clostridium_bolteae | Clostridium_symbiosum | *Blautia producta* | ++++ |
| SPC10325 | SPC10355 | SPC10567 | Clostridium_bolteae | Clostridium_symbiosum | Eubacterium_rectale | − |
| SPC10325 | SPC10355 | SPC10386 | Clostridium_bolteae | Clostridium_symbiosum | Faecalibacterium_prausnitzii | − |
| SPC10325 | SPC10355 | SPC10390 | Clostridium_bolteae | Clostridium_symbiosum | Lachnospiraceae_bacterium_5_1_57FAA | |
| SPC10325 | SPC10386 | SPC10415 | Clostridium_bolteae | Faecalibacterium_prausnitzii | *Blautia producta* | ++++ |
| SPC10325 | SPC10386 | SPC10567 | Clostridium_bolteae | Faecalibacterium_prausnitzii | Eubacterium_rectale | |
| SPC10325 | SPC10386 | SPC10390 | Clostridium_bolteae | Faecalibacterium_prausnitzii | Lachnospiraceae_bacterium_5_1_57FAA | ++++ |
| SPC10325 | SPC10390 | SPC10415 | Clostridium_bolteae | Lachnospiraceae_bacterium_5_1_57FAA | *Blautia producta* | ++++ |
| SPC10325 | SPC10390 | SPC10567 | Clostridium_bolteae | Lachnospiraceae_bacterium_5_1_57FAA | Eubacterium_rectale | + |
| SPC10355 | SPC10415 | SPC10567 | Clostridium_symbiosum | *Blautia producta* | Eubacterium_rectale | ++++ |
| SPC10355 | SPC10386 | SPC10415 | Clostridium_symbiosum | Faecalibacterium_prausnitzii | *Blautia producta* | ++++ |
| SPC10355 | SPC10386 | SPC10567 | Clostridium_symbiosum | Faecalibacterium_prausnitzii | Eubacterium_rectale | |
| SPC10355 | SPC10386 | SPC10390 | Clostridium_symbiosum | Faecalibacterium_prausnitzii | Lachnospiraceae_bacterium_5_1_57FAA | + |
| SPC10355 | SPC10390 | SPC10415 | Clostridium_symbiosum | Lachnospiraceae_bacterium_5_1_57FAA | *Blautia producta* | ++++ |
| SPC10355 | SPC10390 | SPC10567 | Clostridium_symbiosum | Lachnospiraceae_bacterium_5_1_57FAA | Eubacterium_rectale | |
| SPC10097 | SPC10415 | SPC10567 | Collinsella_aerofaciens | *Blautia producta* | Eubacterium_rectale | ++++ |
| SPC10097 | SPC10325 | SPC10415 | Collinsella_aerofaciens | Clostridium_bolteae | *Blautia producta* | ++++ |
| SPC10097 | SPC10325 | SPC10355 | Collinsella_aerofaciens | Clostridium_bolteae | Clostridium_symbiosum | ++++ |
| SPC10097 | SPC10325 | SPC10567 | Collinsella_aerofaciens | Clostridium_bolteae | Eubacterium_rectale | ++++ |
| SPC10097 | SPC10325 | SPC10386 | Collinsella_aerofaciens | Clostridium_bolteae | Faecalibacterium_prausnitzii | ++++ |
| SPC10097 | SPC10325 | SPC10390 | Collinsella_aerofaciens | Clostridium_bolteae | Lachnospiraceae_bacterium_5_1_57FAA | ++++ |
| SPC10097 | SPC10355 | SPC10415 | Collinsella_aerofaciens | Clostridium_symbiosum | *Blautia producta* | ++++ |
| SPC10097 | SPC10355 | SPC10567 | Collinsella_aerofaciens | Clostridium_symbiosum | Eubacterium_rectale | |
| SPC10097 | SPC10355 | SPC10386 | Collinsella_aerofaciens | Clostridium_symbiosum | Faecalibacterium_prausnitzii | |
| SPC10097 | SPC10355 | SPC10390 | Collinsella_aerofaciens | Clostridium_symbiosum | Lachnospiraceae_bacterium_5_1_57FAA | + |
| SPC10097 | SPC10304 | SPC10415 | Collinsella_aerofaciens | Coprococcus_comes | *Blautia producta* | ++++ |
| SPC10097 | SPC10304 | SPC10325 | Collinsella_aerofaciens | Coprococcus_comes | Clostridium_bolteae | ++++ |
| SPC10097 | SPC10304 | SPC10355 | Collinsella_aerofaciens | Coprococcus_comes | Clostridium_symbiosum | +++ |
| SPC10097 | SPC10304 | SPC10567 | Collinsella_aerofaciens | Coprococcus_comes | Eubacterium_rectale | +++ |
| SPC10097 | SPC10304 | SPC10386 | Collinsella_aerofaciens | Coprococcus_comes | Faecalibacterium_prausnitzii | ++++ |
| SPC10097 | SPC10304 | SPC10390 | Collinsella_aerofaciens | Coprococcus_comes | Lachnospiraceae_bacterium_5_1_57FAA | +++ |
| SPC10097 | SPC10386 | SPC10415 | Collinsella_aerofaciens | Faecalibacterium_prausnitzii | *Blautia producta* | ++++ |
| SPC10097 | SPC10386 | SPC10567 | Collinsella_aerofaciens | Faecalibacterium_prausnitzii | Eubacterium_rectale | +++ |
| SPC10097 | SPC10386 | SPC10390 | Collinsella_aerofaciens | Faecalibacterium_prausnitzii | Lachnospiraceae_bacterium_5_1_57FAA | +++ |
| SPC10097 | SPC10390 | SPC10415 | Collinsella_aerofaciens | Lachnospiraceae_bacterium_5_1_57FAA | *Blautia producta* | ++++ |
| SPC10097 | SPC10390 | SPC10567 | Collinsella_aerofaciens | Lachnospiraceae_bacterium_5_1_57FAA | Eubacterium_rectale | ++++ |
| SPC10304 | SPC10415 | SPC10567 | Coprococcus_comes | *Blautia producta* | Eubacterium_rectale | ++++ |
| SPC10304 | SPC10325 | SPC10415 | Coprococcus_comes | Clostridium_bolteae | *Blautia producta* | ++++ |
| SPC10304 | SPC10325 | SPC10355 | Coprococcus_comes | Clostridium_bolteae | Clostridium_symbiosum | |
| SPC10304 | SPC10325 | SPC10567 | Coprococcus_comes | Clostridium_bolteae | Eubacterium_rectale | −− |
| SPC10304 | SPC10325 | SPC10386 | Coprococcus_comes | Clostridium_bolteae | Faecalibacterium_prausnitzii | +++ |
| SPC10304 | SPC10325 | SPC10390 | Coprococcus_comes | Clostridium_bolteae | Lachnospiraceae_bacterium_5_1_57FAA | +++ |
| SPC10304 | SPC10355 | SPC10415 | Coprococcus_comes | Clostridium_symbiosum | *Blautia producta* | ++++ |
| SPC10304 | SPC10355 | SPC10567 | Coprococcus_comes | Clostridium_symbiosum | Eubacterium_rectale | −−− |
| SPC10304 | SPC10355 | SPC10386 | Coprococcus_comes | Clostridium_symbiosum | Faecalibacterium_prausnitzii | |
| SPC10304 | SPC10355 | SPC10390 | Coprococcus_comes | Clostridium_symbiosum | Lachnospiraceae_bacterium_5_1_57FAA | |
| SPC10304 | SPC10386 | SPC10415 | Coprococcus_comes | Faecalibacterium_prausnitzii | *Blautia producta* | ++++ |

TABLE 8-continued

| SPC1 | SPC2 | SPC3 | OTU1 | OTU2 | OTU3 | Results |
|---|---|---|---|---|---|---|
| SPC10304 | SPC10386 | SPC10567 | Coprococcus_comes | Faecalibacterium_prausnitzii | Eubacterium_rectale | − |
| SPC10304 | SPC10386 | SPC10390 | Coprococcus_comes | Faecalibacterium_prausnitzii | Lachnospiraceae_bacterium_5_1_57FAA | |
| SPC10304 | SPC10390 | SPC10415 | Coprococcus_comes | Lachnospiraceae_bacterium_5_1_57FAA | *Blautia producta* | ++++ |
| SPC10304 | SPC10390 | SPC10567 | Coprococcus_comes | Lachnospiraceae_bacterium_5_1_57FAA | Eubacterium_rectale | |
| SPC10386 | SPC10415 | SPC10567 | Faecalibacterium_prausnitzii | *Blautia producta* | Eubacterium_rectale | ++++ |
| SPC10386 | SPC10390 | SPC10415 | Faecalibacterium_prausnitzii | Lachnospiraceae_bacterium_5_1_57FAA | *Blautia producta* | ++++ |
| SPC10386 | SPC10390 | SPC10567 | Faecalibacterium_prausnitzii | Lachnospiraceae_bacterium_5_1_57FAA | Eubacterium_rectale | |
| SPC10390 | SPC10415 | SPC10567 | Lachnospiraceae_bacterium_5_1_57FAA | *Blautia producta* | Eubacterium_rectale | ++++ |

TABLE 9

| SPC1 | SPC2 | OTU1 | OTU2 | Result |
|---|---|---|---|---|
| SPC10414 | SPC10414 | Alistipes_shahii | Alistipes_shahii | |
| SPC10211 | SPC10414 | Bacteroides_caccae | Alistipes_shahii | |
| SPC10213 | SPC10414 | Bacteroides_eggerthii | Alistipes_shahii | −− |
| SPC10030 | SPC10414 | Bacteroides_ovatus | Alistipes_shahii | |
| SPC00006 | SPC10414 | Bacteroides_sp_1_1_6 | Alistipes_shahii | ++++ |
| SPC00007 | SPC10414 | Bacteroides_sp_3_1_23 | Alistipes_shahii | + |
| SPC10019 | SPC10414 | Bacteroides_sp_D20 | Alistipes_shahii | − |
| SPC00005 | SPC10414 | Bacteroides_vulgatus | Alistipes_shahii | +++ |
| SPC10081 | SPC10414 | Bacteroides_vulgatus | Alistipes_shahii | + |
| SPC10301 | SPC10414 | Bifidobacterium_adolescentis | Alistipes_shahii | ++++ |
| SPC10298 | SPC10414 | Bifidobacterium_pseudocatenulatum | Alistipes_shahii | |
| SPC00021 | SPC10414 | Blautia_producta | Alistipes_shahii | ++++ |
| SPC10403 | SPC10414 | Blautia_schinkii | Alistipes_shahii | |
| SPC10243 | SPC10414 | Clostridium_hathewayi | Alistipes_shahii | ++++ |
| SPC00026 | SPC10414 | Clostridium_nexile | Alistipes_shahii | |
| SPC00027 | SPC10414 | Clostridium_sp_HGF2 | Alistipes_shahii | |
| SPC10355 | SPC10414 | Clostridium_symbiosum | Alistipes_shahii | |
| SPC10097 | SPC10414 | Collinsella_aerofaciens | Alistipes_shahii | ++++ |
| SPC00009 | SPC10414 | Coprobacillus_sp_D7 | Alistipes_shahii | ++++ |
| SPC00080 | SPC10414 | Coprococcus_catus | Alistipes_shahii | − |
| SPC10304 | SPC10414 | Coprococcus_comes | Alistipes_shahii | −−−− |
| SPC00018 | SPC10414 | Dorea_formicigenerans | Alistipes_shahii | |
| SPC00057 | SPC10414 | Dorea_longicatena | Alistipes_shahii | ++++ |
| SPC00008 | SPC10414 | Enterococcus_faecalis | Alistipes_shahii | ++++ |
| SPC10001 | SPC10414 | Erysipelotrichaceae_bacterium | Alistipes_shahii | −−− |
| SPC00001 | SPC10414 | Escherichia_coli | Alistipes_shahii | ++++ |
| SPC10110 | SPC10414 | Escherichia_coli | Alistipes_shahii | ++++ |
| SPC00022 | SPC10414 | Eubacterium_eligens | Alistipes_shahii | −− |
| SPC10363 | SPC10414 | Eubacterium_rectale | Alistipes_shahii | |
| SPC00054 | SPC10414 | Faecalibacterium_prausnitzii | Alistipes_shahii | |
| SPC10386 | SPC10414 | Faecalibacterium_prausnitzii | Alistipes_shahii | + |
| SPC10390 | SPC10414 | Lachnospiraceae_bacterium_5_1_57FAA | Alistipes_shahii | |
| SPC00056 | SPC10414 | Odoribacter_splanchnicus | Alistipes_shahii | |
| SPC10388 | SPC10414 | Odoribacter_splanchnicus | Alistipes_shahii | |
| SPC10048 | SPC10414 | Parabacteroides_merdae | Alistipes_shahii | |
| SPC00061 | SPC10414 | Roseburia_intestinalis | Alistipes_shahii | − |
| SPC10197 | SPC10414 | Ruminococcus_obeum | Alistipes_shahii | |
| SPC10233 | SPC10414 | Ruminococcus_torques | Alistipes_shahii | |
| SPC00015 | SPC10414 | Streptococcus_thermophilus | Alistipes_shahii | |
| SPC10211 | SPC10211 | Bacteroides_caccae | Bacteroides_caccae | ++++ |
| SPC10030 | SPC10211 | Bacteroides_ovatus | Bacteroides_caccae | |
| SPC00006 | SPC10211 | Bacteroides_sp_1_1_6 | Bacteroides_caccae | ++++ |
| SPC00007 | SPC10211 | Bacteroides_sp_3_1_23 | Bacteroides_caccae | +++ |
| SPC10019 | SPC10211 | Bacteroides_sp_D20 | Bacteroides_caccae | +++ |
| SPC00005 | SPC10211 | Bacteroides_vulgatus | Bacteroides_caccae | ++++ |
| SPC10081 | SPC10211 | Bacteroides_vulgatus | Bacteroides_caccae | + |
| SPC00021 | SPC10211 | Blautia_producta | Bacteroides_caccae | ++++ |
| SPC00026 | SPC10211 | Clostridium_nexile | Bacteroides_caccae | |
| SPC00027 | SPC10211 | Clostridium_sp_HGF2 | Bacteroides_caccae | |
| SPC10097 | SPC10211 | Collinsella_aerofaciens | Bacteroides_caccae | ++++ |
| SPC00009 | SPC10211 | Coprobacillus_sp_D7 | Bacteroides_caccae | +++ |
| SPC00080 | SPC10211 | Coprococcus_catus | Bacteroides_caccae | ++++ |
| SPC00018 | SPC10211 | Dorea_formicigenerans | Bacteroides_caccae | +++ |
| SPC00057 | SPC10211 | Dorea_longicatena | Bacteroides_caccae | |
| SPC00008 | SPC10211 | Enterococcus_faecalis | Bacteroides_caccae | ++++ |
| SPC10001 | SPC10211 | Erysipelotrichaceae_bacterium | Bacteroides_caccae | ++ |

TABLE 9-continued

| SPC1 | SPC2 | OTU1 | OTU2 | Result |
|---|---|---|---|---|
| SPC00001 | SPC10211 | Escherichia_coli | Bacteroides_caccae | ++++ |
| SPC10110 | SPC10211 | Escherichia_coli | Bacteroides_caccae | ++++ |
| SPC00022 | SPC10211 | Eubacterium_eligens | Bacteroides_caccae | ++ |
| SPC00054 | SPC10211 | Faecalibacterium_prausnitzii | Bacteroides_caccae | − |
| SPC00056 | SPC10211 | Odoribacter_splanchnicus | Bacteroides_caccae | |
| SPC10048 | SPC10211 | Parabacteroides_merdae | Bacteroides_caccae | + |
| SPC00061 | SPC10211 | Roseburia_intestinalis | Bacteroides_caccae | + |
| SPC10197 | SPC10211 | Ruminococcus_obeum | Bacteroides_caccae | ++++ |
| SPC00015 | SPC10211 | Streptococcus_thermophilus | Bacteroides_caccae | ++ |
| SPC10211 | SPC10213 | Bacteroides_caccae | Bacteroides_eggerthii | ++++ |
| SPC10213 | SPC10213 | Bacteroides_eggerthii | Bacteroides_eggerthii | ++++ |
| SPC10030 | SPC10213 | Bacteroides_ovatus | Bacteroides_eggerthii | |
| SPC00006 | SPC10213 | Bacteroides_sp_1_1_6 | Bacteroides_eggerthii | +++ |
| SPC00007 | SPC10213 | Bacteroides_sp_3_1_23 | Bacteroides_eggerthii | ++ |
| SPC10019 | SPC10213 | Bacteroides_sp_D20 | Bacteroides_eggerthii | |
| SPC00005 | SPC10213 | Bacteroides_vulgatus | Bacteroides_eggerthii | ++++ |
| SPC10081 | SPC10213 | Bacteroides_vulgatus | Bacteroides_eggerthii | + |
| SPC00021 | SPC10213 | Blautia_producta | Bacteroides_eggerthii | ++++ |
| SPC00026 | SPC10213 | Clostridium_nexile | Bacteroides_eggerthii | |
| SPC00027 | SPC10213 | Clostridium_sp_HGF2 | Bacteroides_eggerthii | − |
| SPC10097 | SPC10213 | Collinsella_aerofaciens | Bacteroides_eggerthii | ++++ |
| SPC00009 | SPC10213 | Coprobacillus_sp_D7 | Bacteroides_eggerthii | |
| SPC00080 | SPC10213 | Coprococcus_catus | Bacteroides_eggerthii | + |
| SPC00018 | SPC10213 | Dorea_formicigenerans | Bacteroides_eggerthii | |
| SPC00057 | SPC10213 | Dorea_longicatena | Bacteroides_eggerthii | − |
| SPC00008 | SPC10213 | Enterococcus_faecalis | Bacteroides_eggerthii | ++++ |
| SPC10001 | SPC10213 | Erysipelotrichaceae_bacterium | Bacteroides_eggerthii | |
| SPC00001 | SPC10213 | Escherichia_coli | Bacteroides_eggerthii | ++++ |
| SPC10110 | SPC10213 | Escherichia_coli | Bacteroides_eggerthii | ++++ |
| SPC00022 | SPC10213 | Eubacterium_eligens | Bacteroides_eggerthii | |
| SPC00054 | SPC10213 | Faecalibacterium_prausnitzii | Bacteroides_eggerthii | |
| SPC00056 | SPC10213 | Odoribacter_splanchnicus | Bacteroides_eggerthii | |
| SPC10048 | SPC10213 | Parabacteroides_merdae | Bacteroides_eggerthii | |
| SPC00061 | SPC10213 | Roseburia_intestinalis | Bacteroides_eggerthii | |
| SPC10197 | SPC10213 | Ruminococcus_obeum | Bacteroides_eggerthii | ++++ |
| SPC00015 | SPC10213 | Streptococcus_thermophilus | Bacteroides_eggerthii | |
| SPC10030 | SPC10030 | Bacteroides_ovatus | Bacteroides_ovatus | +++ |
| SPC00006 | SPC10030 | Bacteroides_sp_1_1_6 | Bacteroides_ovatus | ++++ |
| SPC00007 | SPC10030 | Bacteroides_sp_3_1_23 | Bacteroides_ovatus | |
| SPC10019 | SPC10030 | Bacteroides_sp_D20 | Bacteroides_ovatus | − |
| SPC00005 | SPC10030 | Bacteroides_vulgatus | Bacteroides_ovatus | + |
| SPC00021 | SPC10030 | Blautia_producta | Bacteroides_ovatus | ++++ |
| SPC00026 | SPC10030 | Clostridium_nexile | Bacteroides_ovatus | |
| SPC00027 | SPC10030 | Clostridium_sp_HGF2 | Bacteroides_ovatus | |
| SPC00009 | SPC10030 | Coprobacillus_sp_D7 | Bacteroides_ovatus | |
| SPC00080 | SPC10030 | Coprococcus_catus | Bacteroides_ovatus | |
| SPC00018 | SPC10030 | Dorea_formicigenerans | Bacteroides_ovatus | |
| SPC00057 | SPC10030 | Dorea_longicatena | Bacteroides_ovatus | − |
| SPC00008 | SPC10030 | Enterococcus_faecalis | Bacteroides_ovatus | ++++ |
| SPC10001 | SPC10030 | Erysipelotrichaceae_bacterium | Bacteroides_ovatus | |
| SPC00001 | SPC10030 | Escherichia_coli | Bacteroides_ovatus | ++++ |
| SPC00022 | SPC10030 | Eubacterium_eligens | Bacteroides_ovatus | − |
| SPC00054 | SPC10030 | Faecalibacterium_prausnitzii | Bacteroides_ovatus | |
| SPC00056 | SPC10030 | Odoribacter_splanchnicus | Bacteroides_ovatus | |
| SPC00061 | SPC10030 | Roseburia_intestinalis | Bacteroides_ovatus | |
| SPC00015 | SPC10030 | Streptococcus_thermophilus | Bacteroides_ovatus | ++ |
| SPC00006 | SPC00006 | Bacteroides_sp_1_1_6 | Bacteroides_sp_1_1_6 | ++++ |
| SPC00005 | SPC00006 | Bacteroides_vulgatus | Bacteroides_sp_1_1_6 | ++++ |
| SPC00001 | SPC00006 | Escherichia_coli | Bacteroides_sp_1_1_6 | ++++ |
| SPC00006 | SPC00007 | Bacteroides_sp_1_1_6 | Bacteroides_sp_3_1_23 | ++++ |
| SPC00007 | SPC00007 | Bacteroides_sp_3_1_23 | Bacteroides_sp_3_1_23 | |
| SPC00005 | SPC00007 | Bacteroides_vulgatus | Bacteroides_sp_3_1_23 | +++ |
| SPC00001 | SPC00007 | Escherichia_coli | Bacteroides_sp_3_1_23 | ++++ |
| SPC00006 | SPC10019 | Bacteroides_sp_1_1_6 | Bacteroides_sp_D20 | ++++ |
| SPC00007 | SPC10019 | Bacteroides_sp_3_1_23 | Bacteroides_sp_D20 | ++++ |
| SPC10019 | SPC10019 | Bacteroides_sp_D20 | Bacteroides_sp_D20 | |
| SPC00005 | SPC10019 | Bacteroides_vulgatus | Bacteroides_sp_D20 | + |
| SPC00021 | SPC10019 | Blautia_producta | Bacteroides_sp_D20 | ++++ |
| SPC00026 | SPC10019 | Clostridium_nexile | Bacteroides_sp_D20 | − |
| SPC00027 | SPC10019 | Clostridium_sp_HGF2 | Bacteroides_sp_D20 | |
| SPC00009 | SPC10019 | Coprobacillus_sp_D7 | Bacteroides_sp_D20 | |
| SPC00080 | SPC10019 | Coprococcus_catus | Bacteroides_sp_D20 | |
| SPC00018 | SPC10019 | Dorea_formicigenerans | Bacteroides_sp_D20 | − |
| SPC00057 | SPC10019 | Dorea_longicatena | Bacteroides_sp_D20 | |
| SPC00008 | SPC10019 | Enterococcus_faecalis | Bacteroides_sp_D20 | ++++ |
| SPC10001 | SPC10019 | Erysipelotrichaceae_bacterium | Bacteroides_sp_D20 | |
| SPC00001 | SPC10019 | Escherichia_coli | Bacteroides_sp_D20 | ++++ |
| SPC00022 | SPC10019 | Eubacterium_eligens | Bacteroides_sp_D20 | − |

TABLE 9-continued

| SPC1 | SPC2 | OTU1 | OTU2 | Result |
|---|---|---|---|---|
| SPC00054 | SPC10019 | Faecalibacterium_prausnitzii | Bacteroides_sp_D20 | |
| SPC00056 | SPC10019 | Odoribacter_splanchnicus | Bacteroides_sp_D20 | |
| SPC00061 | SPC10019 | Roseburia_intestinalis | Bacteroides_sp_D20 | − |
| SPC00015 | SPC10019 | Streptococcus_thermophilus | Bacteroides_sp_D20 | + |
| SPC10030 | SPC10081 | Bacteroides_ovatus | Bacteroides_vulgatus | |
| SPC00006 | SPC10081 | Bacteroides_sp_1_1_6 | Bacteroides_vulgatus | |
| SPC00007 | SPC10081 | Bacteroides_sp_3_1_23 | Bacteroides_vulgatus | − |
| SPC10019 | SPC10081 | Bacteroides_sp_D20 | Bacteroides_vulgatus | |
| SPC00005 | SPC00005 | Bacteroides_vulgatus | Bacteroides_vulgatus | + |
| SPC00005 | SPC10081 | Bacteroides_vulgatus | Bacteroides_vulgatus | ++ |
| SPC10081 | SPC10081 | Bacteroides_vulgatus | Bacteroides_vulgatus | |
| SPC00021 | SPC10081 | Blautia_producta | Bacteroides_vulgatus | ++++ |
| SPC00026 | SPC10081 | Clostridium_nexile | Bacteroides_vulgatus | |
| SPC00027 | SPC10081 | Clostridium_sp_HGF2 | Bacteroides_vulgatus | +++ |
| SPC00009 | SPC10081 | Coprobacillus_sp_D7 | Bacteroides_vulgatus | − |
| SPC00080 | SPC10081 | Coprococcus_catus | Bacteroides_vulgatus | ++ |
| SPC00018 | SPC10081 | Dorea_formicigenerans | Bacteroides_vulgatus | |
| SPC00057 | SPC10081 | Dorea_longicatena | Bacteroides_vulgatus | |
| SPC00008 | SPC10081 | Enterococcus_faecalis | Bacteroides_vulgatus | ++++ |
| SPC10001 | SPC10081 | Erysipelotrichaceae_bacterium | Bacteroides_vulgatus | |
| SPC00001 | SPC00005 | Escherichia_coli | Bacteroides_vulgatus | ++++ |
| SPC00001 | SPC10081 | Escherichia_coli | Bacteroides_vulgatus | ++++ |
| SPC00022 | SPC10081 | Eubacterium_eligens | Bacteroides_vulgatus | |
| SPC00054 | SPC10081 | Faecalibacterium_prausnitzii | Bacteroides_vulgatus | |
| SPC00056 | SPC10081 | Odoribacter_splanchnicus | Bacteroides_vulgatus | |
| SPC10048 | SPC10081 | Parabacteroides_merdae | Bacteroides_vulgatus | + |
| SPC00061 | SPC10081 | Roseburia_intestinalis | Bacteroides_vulgatus | |
| SPC00015 | SPC10081 | Streptococcus_thermophilus | Bacteroides_vulgatus | −− |
| SPC10211 | SPC10301 | Bacteroides_caccae | Bifidobacterium_adolescentis | ++++ |
| SPC10213 | SPC10301 | Bacteroides_eggerthii | Bifidobacterium_adolescentis | ++++ |
| SPC10030 | SPC10301 | Bacteroides_ovatus | Bifidobacterium_adolescentis | ++++ |
| SPC00006 | SPC10301 | Bacteroides_sp_1_1_6 | Bifidobacterium_adolescentis | ++++ |
| SPC00007 | SPC10301 | Bacteroides_sp_3_1_23 | Bifidobacterium_adolescentis | ++++ |
| SPC10019 | SPC10301 | Bacteroides_sp_D20 | Bifidobacterium_adolescentis | ++++ |
| SPC00005 | SPC10301 | Bacteroides_vulgatus | Bifidobacterium_adolescentis | ++++ |
| SPC10081 | SPC10301 | Bacteroides_vulgatus | Bifidobacterium_adolescentis | ++++ |
| SPC10301 | SPC10301 | Bifidobacterium_adolescentis | Bifidobacterium_adolescentis | ++++ |
| SPC10298 | SPC10301 | Bifidobacterium_pseudocatenulatum | Bifidobacterium_adolescentis | ++++ |
| SPC00021 | SPC10301 | Blautia_producta | Bifidobacterium_adolescentis | ++++ |
| SPC10243 | SPC10301 | Clostridium_hathewayi | Bifidobacterium_adolescentis | ++++ |
| SPC00026 | SPC10301 | Clostridium_nexile | Bifidobacterium_adolescentis | ++++ |
| SPC00027 | SPC10301 | Clostridium_sp_HGF2 | Bifidobacterium_adolescentis | ++++ |
| SPC10097 | SPC10301 | Collinsella_aerofaciens | Bifidobacterium_adolescentis | ++++ |
| SPC00009 | SPC10301 | Coprobacillus_sp_D7 | Bifidobacterium_adolescentis | ++++ |
| SPC00080 | SPC10301 | Coprococcus_catus | Bifidobacterium_adolescentis | |
| SPC00018 | SPC10301 | Dorea_formicigenerans | Bifidobacterium_adolescentis | ++++ |
| SPC00057 | SPC10301 | Dorea_longicatena | Bifidobacterium_adolescentis | ++++ |
| SPC00008 | SPC10301 | Enterococcus_faecalis | Bifidobacterium_adolescentis | ++++ |
| SPC10001 | SPC10301 | Erysipelotrichaceae_bacterium | Bifidobacterium_adolescentis | ++++ |
| SPC00001 | SPC10301 | Escherichia_coli | Bifidobacterium_adolescentis | ++++ |
| SPC10110 | SPC10301 | Escherichia_coli | Bifidobacterium_adolescentis | ++++ |
| SPC00022 | SPC10301 | Eubacterium_eligens | Bifidobacterium_adolescentis | ++++ |
| SPC00054 | SPC10301 | Faecalibacterium_prausnitzii | Bifidobacterium_adolescentis | + |
| SPC00056 | SPC10301 | Odoribacter_splanchnicus | Bifidobacterium_adolescentis | +++ |
| SPC10048 | SPC10301 | Parabacteroides_merdae | Bifidobacterium_adolescentis | ++++ |
| SPC00061 | SPC10301 | Roseburia_intestinalis | Bifidobacterium_adolescentis | +++ |
| SPC10197 | SPC10301 | Ruminococcus_obeum | Bifidobacterium_adolescentis | ++++ |
| SPC10233 | SPC10301 | Ruminococcus_torques | Bifidobacterium_adolescentis | ++++ |
| SPC00015 | SPC10301 | Streptococcus_thermophilus | Bifidobacterium_adolescentis | ++++ |
| SPC10211 | SPC10298 | Bacteroides_caccae | Bifidobacterium_pseudocatenulatum | ++++ |
| SPC10213 | SPC10298 | Bacteroides_eggerthii | Bifidobacterium_pseudocatenulatum | ++++ |
| SPC10030 | SPC10298 | Bacteroides_ovatus | Bifidobacterium_pseudocatenulatum | ++++ |
| SPC00006 | SPC10298 | Bacteroides_sp_1_1_6 | Bifidobacterium_pseudocatenulatum | ++++ |
| SPC00007 | SPC10298 | Bacteroides_sp_3_1_23 | Bifidobacterium_pseudocatenulatum | ++++ |
| SPC10019 | SPC10298 | Bacteroides_sp_D20 | Bifidobacterium_pseudocatenulatum | −− |
| SPC00005 | SPC10298 | Bacteroides_vulgatus | Bifidobacterium_pseudocatenulatum | ++++ |
| SPC10081 | SPC10298 | Bacteroides_vulgatus | Bifidobacterium_pseudocatenulatum | ++++ |
| SPC10298 | SPC10298 | Bifidobacterium_pseudocatenulatum | Bifidobacterium_pseudocatenulatum | ++++ |
| SPC00021 | SPC10298 | Blautia_producta | Bifidobacterium_pseudocatenulatum | + |
| SPC10243 | SPC10298 | Clostridium_hathewayi | Bifidobacterium_pseudocatenulatum | ++++ |
| SPC00026 | SPC10298 | Clostridium_nexile | Bifidobacterium_pseudocatenulatum | ++++ |
| SPC00027 | SPC10298 | Clostridium_sp_HGF2 | Bifidobacterium_pseudocatenulatum | +++ |
| SPC10097 | SPC10298 | Collinsella_aerofaciens | Bifidobacterium_pseudocatenulatum | ++++ |
| SPC00009 | SPC10298 | Coprobacillus_sp_D7 | Bifidobacterium_pseudocatenulatum | +++ |
| SPC00080 | SPC10298 | Coprococcus_catus | Bifidobacterium_pseudocatenulatum | |
| SPC00018 | SPC10298 | Dorea_formicigenerans | Bifidobacterium_pseudocatenulatum | +++ |
| SPC00057 | SPC10298 | Dorea_longicatena | Bifidobacterium_pseudocatenulatum | ++++ |
| SPC00008 | SPC10298 | Enterococcus_faecalis | Bifidobacterium_pseudocatenulatum | ++++ |

TABLE 9-continued

| SPC1 | SPC2 | OTU1 | OTU2 | Result |
|---|---|---|---|---|
| SPC10001 | SPC10298 | Erysipelotrichaceae_bacterium | Bifidobacterium_pseudocatenulatum | |
| SPC00001 | SPC10298 | Escherichia_coli | Bifidobacterium_pseudocatenulatum | ++++ |
| SPC10110 | SPC10298 | Escherichia_coli | Bifidobacterium_pseudocatenulatum | ++++ |
| SPC00022 | SPC10298 | Eubacterium_eligens | Bifidobacterium_pseudocatenulatum | ++++ |
| SPC00054 | SPC10298 | Faecalibacterium_prausnitzii | Bifidobacterium_pseudocatenulatum | ++ |
| SPC00056 | SPC10298 | Odoribacter_splanchnicus | Bifidobacterium_pseudocatenulatum | + |
| SPC10048 | SPC10298 | Parabacteroides_merdae | Bifidobacterium_pseudocatenulatum | ++++ |
| SPC00061 | SPC10298 | Roseburia_intestinalis | Bifidobacterium_pseudocatenulatum | +++ |
| SPC10197 | SPC10298 | Ruminococcus_obeum | Bifidobacterium_pseudocatenulatum | ++++ |
| SPC10233 | SPC10298 | Ruminococcus_torques | Bifidobacterium_pseudocatenulatum | ++++ |
| SPC00015 | SPC10298 | Streptococcus_thermophilus | Bifidobacterium_pseudocatenulatum | ++++ |
| SPC10414 | SPC10415 | Alistipes_shahii | Blautia_producta | |
| SPC10211 | SPC10415 | Bacteroides_caccae | Blautia_producta | + |
| SPC10213 | SPC10415 | Bacteroides_eggerthii | Blautia_producta | |
| SPC10030 | SPC10415 | Bacteroides_ovatus | Blautia_producta | − |
| SPC00006 | SPC00021 | Bacteroides_sp_1_1_6 | Blautia_producta | ++++ |
| SPC00006 | SPC10415 | Bacteroides_sp_1_1_6 | Blautia_producta | ++++ |
| SPC00007 | SPC00021 | Bacteroides_sp_3_1_23 | Blautia_producta | ++++ |
| SPC00007 | SPC10415 | Bacteroides_sp_3_1_23 | Blautia_producta | ++ |
| SPC10019 | SPC10415 | Bacteroides_sp_D20 | Blautia_producta | |
| SPC00005 | SPC00021 | Bacteroides_vulgatus | Blautia_producta | ++++ |
| SPC00005 | SPC10415 | Bacteroides_vulgatus | Blautia_producta | ++++ |
| SPC10081 | SPC10415 | Bacteroides_vulgatus | Blautia_producta | ++++ |
| SPC10301 | SPC10415 | Bifidobacterium_adolescentis | Blautia_producta | ++++ |
| SPC10298 | SPC10415 | Bifidobacterium_pseudocatenulatum | Blautia_producta | |
| SPC00021 | SPC00021 | Blautia_producta | Blautia_producta | ++++ |
| SPC00021 | SPC10415 | Blautia_producta | Blautia_producta | ++++ |
| SPC10415 | SPC10415 | Blautia_producta | Blautia_producta | + |
| SPC10415 | SPC10415 | Blautia_producta | Blautia_producta | ++++ |
| SPC10403 | SPC10415 | Blautia_schinkii | Blautia_producta | |
| SPC10256 | SPC10415 | Clostridium_butyricum | Blautia_producta | ++++ |
| SPC10358 | SPC10415 | Clostridium_orbiscindens | Blautia_producta | ++++ |
| SPC10325 | SPC10415 | Clostridium_bolteae | Blautia_producta | ++++ |
| SPC10167 | SPC10415 | Clostridium_disporicum | Blautia_producta | ++++ |
| SPC10243 | SPC10415 | Clostridium_hathewayi | Blautia_producta | +++ |
| SPC10313 | SPC10415 | Clostridium_hylemonae | Blautia_producta | ++++ |
| SPC10202 | SPC10415 | Clostridium_innocuum | Blautia_producta | ++++ |
| SPC10238 | SPC10415 | Clostridium_mayombei | Blautia_producta | ++++ |
| SPC00026 | SPC10415 | Clostridium_nexile | Blautia_producta | − |
| SPC00027 | SPC10415 | Clostridium_sp_HGF2 | Blautia_producta | |
| SPC10355 | SPC10415 | Clostridium_symbiosum | Blautia_producta | |
| SPC10355 | SPC10415 | Clostridium_symbiosum | Blautia_producta | ++++ |
| SPC10155 | SPC10415 | Clostridium_tertium | Blautia_producta | ++++ |
| SPC10097 | SPC10415 | Collinsella_aerofaciens | Blautia_producta | ++++ |
| SPC10097 | SPC10415 | Collinsella_aerofaciens | Blautia_producta | ++++ |
| SPC00009 | SPC00021 | Coprobacillus_sp_D7 | Blautia_producta | ++++ |
| SPC00009 | SPC10415 | Coprobacillus_sp_D7 | Blautia_producta | ++++ |
| SPC00080 | SPC10415 | Coprococcus_catus | Blautia_producta | ---- |
| SPC10304 | SPC10415 | Coprococcus_comes | Blautia_producta | |
| SPC10304 | SPC10415 | Coprococcus_comes | Blautia_producta | ++++ |
| SPC00018 | SPC00021 | Dorea_formicigenerans | Blautia_producta | ++++ |
| SPC00018 | SPC10415 | Dorea_formicigenerans | Blautia_producta | -- |
| SPC00057 | SPC10415 | Dorea_longicatena | Blautia_producta | +++ |
| SPC00008 | SPC00021 | Enterococcus_faecalis | Blautia_producta | ++++ |
| SPC00008 | SPC10415 | Enterococcus_faecalis | Blautia_producta | ++++ |
| SPC10001 | SPC10415 | Erysipelotrichaceae_bacterium | Blautia_producta | --- |
| SPC00001 | SPC00021 | Escherichia_coli | Blautia_producta | ++++ |
| SPC00001 | SPC10415 | Escherichia_coli | Blautia_producta | ++++ |
| SPC10110 | SPC10415 | Escherichia_coli | Blautia_producta | ++++ |
| SPC00022 | SPC10415 | Eubacterium_eligens | Blautia_producta | --- |
| SPC10363 | SPC10415 | Eubacterium_rectale | Blautia_producta | + |
| SPC00054 | SPC10415 | Faecalibacterium_prausnitzii | Blautia_producta | |
| SPC10386 | SPC10415 | Faecalibacterium_prausnitzii | Blautia_producta | + |
| SPC10386 | SPC10415 | Faecalibacterium_prausnitzii | Blautia_producta | ++++ |
| SPC10390 | SPC10415 | Lachnospiraceae_bacterium_5_1_57FAA | Blautia_producta | + |
| SPC10390 | SPC10415 | Lachnospiraceae_bacterium_5_1_57FAA | Blautia_producta | ++++ |
| SPC00056 | SPC10415 | Odoribacter_splanchnicus | Blautia_producta | − |
| SPC10388 | SPC10415 | Odoribacter_splanchnicus | Blautia_producta | + |
| SPC10048 | SPC10415 | Parabacteroides_merdae | Blautia_producta | +++ |
| SPC00061 | SPC10415 | Roseburia_intestinalis | Blautia_producta | -- |
| SPC10468 | SPC10415 | Ruminococcus_gnavus | Blautia_producta | ++++ |
| SPC10197 | SPC10415 | Ruminococcus_obeum | Blautia_producta | |
| SPC10233 | SPC10415 | Ruminococcus_torques | Blautia_producta | |
| SPC00015 | SPC00021 | Streptococcus_thermophilus | Blautia_producta | ++++ |
| SPC00015 | SPC10415 | Streptococcus_thermophilus | Blautia_producta | |
| SPC10211 | SPC10403 | Bacteroides_caccae | Blautia_schinkii | |
| SPC10213 | SPC10403 | Bacteroides_eggerthii | Blautia_schinkii | -- |
| SPC10030 | SPC10403 | Bacteroides_ovatus | Blautia_schinkii | − |

TABLE 9-continued

| SPC1 | SPC2 | OTU1 | OTU2 | Result |
|---|---|---|---|---|
| SPC00006 | SPC10403 | Bacteroides_sp_1_1_6 | Blautia_schinkii | +++ |
| SPC00007 | SPC10403 | Bacteroides_sp_3_1_23 | Blautia_schinkii | + |
| SPC10019 | SPC10403 | Bacteroides_sp_D20 | Blautia_schinkii | −− |
| SPC00005 | SPC10403 | Bacteroides_vulgatus | Blautia_schinkii | ++ |
| SPC10081 | SPC10403 | Bacteroides_vulgatus | Blautia_schinkii | |
| SPC10301 | SPC10403 | Bifidobacterium_adolescentis | Blautia_schinkii | ++ |
| SPC10298 | SPC10403 | Bifidobacterium_pseudocatenulatum | Blautia_schinkii | − |
| SPC00021 | SPC10403 | Blautia_producta | Blautia_schinkii | ++++ |
| SPC10403 | SPC10403 | Blautia_schinkii | Blautia_schinkii | |
| SPC10243 | SPC10403 | Clostridium_hathewayi | Blautia_schinkii | ++++ |
| SPC00026 | SPC10403 | Clostridium_nexile | Blautia_schinkii | −− |
| SPC00027 | SPC10403 | Clostridium_sp_HGF2 | Blautia_schinkii | |
| SPC10355 | SPC10403 | Clostridium_symbiosum | Blautia_schinkii | |
| SPC10097 | SPC10403 | Collinsella_aerofaciens | Blautia_schinkii | ++++ |
| SPC00009 | SPC10403 | Coprobacillus_sp_D7 | Blautia_schinkii | ++++ |
| SPC00080 | SPC10403 | Coprococcus_catus | Blautia_schinkii | −−− |
| SPC10304 | SPC10403 | Coprococcus_comes | Blautia_schinkii | + |
| SPC00018 | SPC10403 | Dorea_formicigenerans | Blautia_schinkii | |
| SPC00057 | SPC10403 | Dorea_longicatena | Blautia_schinkii | +++ |
| SPC00008 | SPC10403 | Enterococcus_faecalis | Blautia_schinkii | ++++ |
| SPC10001 | SPC10403 | Erysipelotrichaceae_bacterium | Blautia_schinkii | −−− |
| SPC00001 | SPC10403 | Escherichia_coli | Blautia_schinkii | ++++ |
| SPC10110 | SPC10403 | Escherichia_coli | Blautia_schinkii | ++++ |
| SPC00022 | SPC10403 | Eubacterium_eligens | Blautia_schinkii | − |
| SPC10363 | SPC10403 | Eubacterium_rectale | Blautia_schinkii | + |
| SPC00054 | SPC10403 | Faecalibacterium_prausnitzii | Blautia_schinkii | |
| SPC10386 | SPC10403 | Faecalibacterium_prausnitzii | Blautia_schinkii | |
| SPC10390 | SPC10403 | Lachnospiraceae_bacterium_5_1_57FAA | Blautia_schinkii | |
| SPC00056 | SPC10403 | Odoribacter_splanchnicus | Blautia_schinkii | − |
| SPC10388 | SPC10403 | Odoribacter_splanchnicus | Blautia_schinkii | |
| SPC10048 | SPC10403 | Parabacteroides_merdae | Blautia_schinkii | |
| SPC00061 | SPC10403 | Roseburia_intestinalis | Blautia_schinkii | − |
| SPC10197 | SPC10403 | Ruminococcus_obeum | Blautia_schinkii | |
| SPC10233 | SPC10403 | Ruminococcus_torques | Blautia_schinkii | |
| SPC00015 | SPC10403 | Streptococcus_thermophilus | Blautia_schinkii | |
| SPC10256 | SPC10256 | Clostridium butyricum | Clostridium butyricum | ++++ |
| SPC10167 | SPC10256 | Clostridium_disporicum | Clostridium butyricum | ++++ |
| SPC10202 | SPC10256 | Clostridium_innocuum | Clostridium butyricum | ++++ |
| SPC10238 | SPC10256 | Clostridium_mayombei | Clostridium butyricum | ++++ |
| SPC10155 | SPC10256 | Clostridium_tertium | Clostridium butyricum | ++++ |
| SPC10097 | SPC10256 | Collinsella_aerofaciens | Clostridium butyricum | ++++ |
| SPC10304 | SPC10256 | Coprococcus_comes | Clostridium butyricum | ++++ |
| SPC10256 | SPC10358 | Clostridium butyricum | Clostridium orbiscindens | ++++ |
| SPC10358 | SPC10358 | Clostridium orbiscindens | Clostridium orbiscindens | + |
| SPC10325 | SPC10358 | Clostridium_bolteae | Clostridium orbiscindens | ++++ |
| SPC10167 | SPC10358 | Clostridium_disporicum | Clostridium orbiscindens | ++++ |
| SPC10313 | SPC10358 | Clostridium_hylemonae | Clostridium orbiscindens | |
| SPC10202 | SPC10358 | Clostridium_innocuum | Clostridium orbiscindens | ++++ |
| SPC10238 | SPC10358 | Clostridium_mayombei | Clostridium orbiscindens | ++++ |
| SPC10355 | SPC10358 | Clostridium_symbiosum | Clostridium orbiscindens | ++++ |
| SPC10155 | SPC10358 | Clostridium_tertium | Clostridium orbiscindens | ++++ |
| SPC10097 | SPC10358 | Collinsella_aerofaciens | Clostridium orbiscindens | ++++ |
| SPC10304 | SPC10358 | Coprococcus_comes | Clostridium orbiscindens | ++++ |
| SPC10386 | SPC10358 | Faecalibacterium_prausnitzii | Clostridium orbiscindens | |
| SPC10256 | SPC10325 | Clostridium butyricum | Clostridium_bolteae | ++++ |
| SPC10325 | SPC10325 | Clostridium_bolteae | Clostridium_bolteae | ++++ |
| SPC10167 | SPC10325 | Clostridium_disporicum | Clostridium_bolteae | ++++ |
| SPC10313 | SPC10325 | Clostridium_hylemonae | Clostridium_bolteae | |
| SPC10202 | SPC10325 | Clostridium_innocuum | Clostridium_bolteae | ++++ |
| SPC10238 | SPC10325 | Clostridium_mayombei | Clostridium_bolteae | ++++ |
| SPC10355 | SPC10325 | Clostridium_symbiosum | Clostridium_bolteae | ++++ |
| SPC10155 | SPC10325 | Clostridium_tertium | Clostridium_bolteae | ++++ |
| SPC10097 | SPC10325 | Collinsella_aerofaciens | Clostridium_bolteae | ++++ |
| SPC10304 | SPC10325 | Coprococcus_comes | Clostridium_bolteae | ++++ |
| SPC10167 | SPC10167 | Clostridium_disporicum | Clostridium_disporicum | +++ |
| SPC10202 | SPC10167 | Clostridium_innocuum | Clostridium_disporicum | +++ |

TABLE 9-continued

| SPC1 | SPC2 | OTU1 | OTU2 | Result |
|---|---|---|---|---|
| SPC10155 | SPC10167 | Clostridium_tertium | Clostridium_disporicum | ++++ |
| SPC10097 | SPC10167 | Collinsella_aerofaciens | Clostridium_disporicum | − |
| SPC10211 | SPC10243 | Bacteroides_caccae | Clostridium_hathewayi | ++++ |
| SPC10213 | SPC10243 | Bacteroides_eggerthii | Clostridium_hathewayi | ++++ |
| SPC10030 | SPC10243 | Bacteroides_ovatus | Clostridium_hathewayi | ++++ |
| SPC00006 | SPC10243 | Bacteroides_sp_1_1_6 | Clostridium_hathewayi | ++++ |
| SPC00007 | SPC10243 | Bacteroides_sp_3_1_23 | Clostridium_hathewayi | ++++ |
| SPC10019 | SPC10243 | Bacteroides_sp_D20 | Clostridium_hathewayi | ++++ |
| SPC00005 | SPC10243 | Bacteroides_vulgatus | Clostridium_hathewayi | ++++ |
| SPC10081 | SPC10243 | Bacteroides_vulgatus | Clostridium_hathewayi | ++++ |
| SPC00021 | SPC10243 | Blautia_producta | Clostridium_hathewayi | ++++ |
| SPC10243 | SPC10243 | Clostridium_hathewayi | Clostridium_hathewayi | ++++ |
| SPC00026 | SPC10243 | Clostridium_nexile | Clostridium_hathewayi | |
| SPC00027 | SPC10243 | Clostridium_sp_HGF2 | Clostridium_hathewayi | |
| SPC10097 | SPC10243 | Collinsella_aerofaciens | Clostridium_hathewayi | ++++ |
| SPC00009 | SPC10243 | Coprobacillus_sp_D7 | Clostridium_hathewayi | ++++ |
| SPC00080 | SPC10243 | Coprococcus_catus | Clostridium_hathewayi | +++ |
| SPC00018 | SPC10243 | Dorea_formicigenerans | Clostridium_hathewayi | ++++ |
| SPC00057 | SPC10243 | Dorea_longicatena | Clostridium_hathewayi | + |
| SPC00008 | SPC10243 | Enterococcus_faecalis | Clostridium_hathewayi | ++++ |
| SPC10001 | SPC10243 | Erysipelotrichaceae_bacterium | Clostridium_hathewayi | ++++ |
| SPC00001 | SPC10243 | Escherichia_coli | Clostridium_hathewayi | ++++ |
| SPC10110 | SPC10243 | Escherichia_coli | Clostridium_hathewayi | ++++ |
| SPC00022 | SPC10243 | Eubacterium_eligens | Clostridium_hathewayi | + |
| SPC00054 | SPC10243 | Faecalibacterium_prausnitzii | Clostridium_hathewayi | |
| SPC00056 | SPC10243 | Odoribacter_splanchnicus | Clostridium_hathewayi | |
| SPC10048 | SPC10243 | Parabacteroides_merdae | Clostridium_hathewayi | + |
| SPC00061 | SPC10243 | Roseburia_intestinalis | Clostridium_hathewayi | +++ |
| SPC10197 | SPC10243 | Ruminococcus_obeum | Clostridium_hathewayi | ++++ |
| SPC10233 | SPC10243 | Ruminococcus_torques | Clostridium_hathewayi | ++++ |
| SPC00015 | SPC10243 | Streptococcus_thermophilus | Clostridium_hathewayi | ++ |
| SPC10256 | SPC10313 | Clostridium butyricum | Clostridium_hylemonae | ++++ |
| SPC10325 | SPC10313 | Clostridium_bolteae | Clostridium_hylemonae | |
| SPC10167 | SPC10313 | Clostridium_disporicum | Clostridium_hylemonae | |
| SPC10313 | SPC10313 | Clostridium_hylemonae | Clostridium_hylemonae | |
| SPC10202 | SPC10313 | Clostridium_innocuum | Clostridium_hylemonae | ++++ |
| SPC10238 | SPC10313 | Clostridium_mayombei | Clostridium_hylemonae | ++++ |
| SPC10155 | SPC10313 | Clostridium_tertium | Clostridium_hylemonae | ++++ |
| SPC10097 | SPC10313 | Collinsella_aerofaciens | Clostridium_hylemonae | +++ |
| SPC10304 | SPC10313 | Coprococcus_comes | Clostridium_hylemonae | + |
| SPC10167 | SPC10202 | Clostridium_disporicum | Clostridium_innocuum | +++ |
| SPC10202 | SPC10202 | Clostridium_innocuum | Clostridium_innocuum | ++++ |
| SPC10238 | SPC10202 | Clostridium_mayombei | Clostridium_innocuum | ++++ |
| SPC10155 | SPC10202 | Clostridium_tertium | Clostridium_innocuum | ++++ |
| SPC10097 | SPC10202 | Collinsella_aerofaciens | Clostridium_innocuum | +++ |
| SPC10256 | SPC10238 | Clostridium butyricum | Clostridium_mayombei | ++++ |
| SPC10167 | SPC10238 | Clostridium_disporicum | Clostridium_mayombei | ++++ |
| SPC10202 | SPC10238 | Clostridium_innocuum | Clostridium_mayombei | ++++ |
| SPC10238 | SPC10238 | Clostridium_mayombei | Clostridium_mayombei | ++++ |
| SPC10155 | SPC10238 | Clostridium_tertium | Clostridium_mayombei | ++++ |
| SPC10097 | SPC10238 | Collinsella_aerofaciens | Clostridium_mayombei | ++++ |
| SPC00006 | SPC00026 | Bacteroides_sp_1_1_6 | Clostridium_nexile | ++++ |
| SPC00007 | SPC00026 | Bacteroides_sp_3_1_23 | Clostridium_nexile | ++++ |
| SPC00005 | SPC00026 | Bacteroides_vulgatus | Clostridium_nexile | ++++ |
| SPC00021 | SPC00026 | Blautia_producta | Clostridium_nexile | ++++ |
| SPC00026 | SPC00026 | Clostridium_nexile | Clostridium_nexile | ++ |
| SPC00009 | SPC00026 | Coprobacillus_sp_D7 | Clostridium_nexile | |
| SPC00018 | SPC00026 | Dorea_formicigenerans | Clostridium_nexile | |
| SPC00008 | SPC00026 | Enterococcus_faecalis | Clostridium_nexile | ++++ |
| SPC00001 | SPC00026 | Escherichia_coli | Clostridium_nexile | ++++ |
| SPC00022 | SPC00026 | Eubacterium_eligens | Clostridium_nexile | + |
| SPC00015 | SPC00026 | Streptococcus_thermophilus | Clostridium_nexile | + |
| SPC00006 | SPC00027 | Bacteroides_sp_1_1_6 | Clostridium_sp_HGF2 | ++++ |
| SPC00007 | SPC00027 | Bacteroides_sp_3_1_23 | Clostridium_sp_HGF2 | ++++ |
| SPC00005 | SPC00027 | Bacteroides_vulgatus | Clostridium_sp_HGF2 | ++ |
| SPC00021 | SPC00027 | Blautia_producta | Clostridium_sp_HGF2 | ++++ |
| SPC00026 | SPC00027 | Clostridium_nexile | Clostridium_sp_HGF2 | ++++ |
| SPC00027 | SPC00027 | Clostridium_sp_HGF2 | Clostridium_sp_HGF2 | ++++ |
| SPC00009 | SPC00027 | Coprobacillus_sp_D7 | Clostridium_sp_HGF2 | − |
| SPC00018 | SPC00027 | Dorea_formicigenerans | Clostridium_sp_HGF2 | |
| SPC00008 | SPC00027 | Enterococcus_faecalis | Clostridium_sp_HGF2 | ++++ |
| SPC00001 | SPC00027 | Escherichia_coli | Clostridium_sp_HGF2 | ++++ |
| SPC00022 | SPC00027 | Eubacterium_eligens | Clostridium_sp_HGF2 | |
| SPC00015 | SPC00027 | Streptococcus_thermophilus | Clostridium_sp_HGF2 | + |
| SPC10211 | SPC10355 | Bacteroides_caccae | Clostridium_symbiosum | +++ |
| SPC10213 | SPC10355 | Bacteroides_eggerthii | Clostridium_symbiosum | ++++ |
| SPC10030 | SPC10355 | Bacteroides_ovatus | Clostridium_symbiosum | |
| SPC00006 | SPC10355 | Bacteroides_sp_1_1_6 | Clostridium_symbiosum | ++++ |

TABLE 9-continued

| SPC1 | SPC2 | OTU1 | OTU2 | Result |
|---|---|---|---|---|
| SPC00007 | SPC10355 | Bacteroides_sp_3_1_23 | Clostridium_symbiosum | ++++ |
| SPC10019 | SPC10355 | Bacteroides_sp_D20 | Clostridium_symbiosum | |
| SPC00005 | SPC10355 | Bacteroides_vulgatus | Clostridium_symbiosum | +++ |
| SPC10081 | SPC10355 | Bacteroides_vulgatus | Clostridium_symbiosum | |
| SPC10301 | SPC10355 | Bifidobacterium_adolescentis | Clostridium_symbiosum | ++++ |
| SPC10298 | SPC10355 | Bifidobacterium_pseudocatenulatum | Clostridium_symbiosum | + |
| SPC00021 | SPC10355 | Blautia_producta | Clostridium_symbiosum | ++++ |
| SPC10256 | SPC10355 | Clostridium_butyricum | Clostridium_symbiosum | ++++ |
| SPC10358 | SPC10355 | Clostridium_orbiscindens | Clostridium_symbiosum | ++++ |
| SPC10325 | SPC10355 | Clostridium_bolteae | Clostridium_symbiosum | ++++ |
| SPC10167 | SPC10355 | Clostridium_disporicum | Clostridium_symbiosum | ++++ |
| SPC10243 | SPC10355 | Clostridium_hathewayi | Clostridium_symbiosum | ++++ |
| SPC10313 | SPC10355 | Clostridium_hylemonae | Clostridium_symbiosum | +++ |
| SPC10202 | SPC10355 | Clostridium_innocuum | Clostridium_symbiosum | ++++ |
| SPC10238 | SPC10355 | Clostridium_mayombei | Clostridium_symbiosum | ++++ |
| SPC00026 | SPC10355 | Clostridium_nexile | Clostridium_symbiosum | + |
| SPC00027 | SPC10355 | Clostridium_sp_HGF2 | Clostridium_symbiosum | |
| SPC10355 | SPC10355 | Clostridium_symbiosum | Clostridium_symbiosum | + |
| SPC10355 | SPC10355 | Clostridium_symbiosum | Clostridium_symbiosum | ++++ |
| SPC10155 | SPC10355 | Clostridium_tertium | Clostridium_symbiosum | + |
| SPC10097 | SPC10355 | Collinsella_aerofaciens | Clostridium_symbiosum | +++ |
| SPC10097 | SPC10355 | Collinsella_aerofaciens | Clostridium_symbiosum | ++++ |
| SPC00009 | SPC10355 | Coprobacillus_sp_D7 | Clostridium_symbiosum | |
| SPC00080 | SPC10355 | Coprococcus_catus | Clostridium_symbiosum | − |
| SPC10304 | SPC10355 | Coprococcus_comes | Clostridium_symbiosum | |
| SPC10304 | SPC10355 | Coprococcus_comes | Clostridium_symbiosum | ++++ |
| SPC00018 | SPC10355 | Dorea_formicigenerans | Clostridium_symbiosum | |
| SPC00057 | SPC10355 | Dorea_longicatena | Clostridium_symbiosum | ++++ |
| SPC00008 | SPC10355 | Enterococcus_faecalis | Clostridium_symbiosum | ++++ |
| SPC10001 | SPC10355 | Erysipelotrichaceae_bacterium | Clostridium_symbiosum | |
| SPC00001 | SPC10355 | Escherichia_coli | Clostridium_symbiosum | ++++ |
| SPC10110 | SPC10355 | Escherichia_coli | Clostridium_symbiosum | ++++ |
| SPC00022 | SPC10355 | Eubacterium_eligens | Clostridium_symbiosum | + |
| SPC00054 | SPC10355 | Faecalibacterium_prausnitzii | Clostridium_symbiosum | |
| SPC00056 | SPC10355 | Odoribacter_splanchnicus | Clostridium_symbiosum | |
| SPC10048 | SPC10355 | Parabacteroides_merdae | Clostridium_symbiosum | − |
| SPC00061 | SPC10355 | Roseburia_intestinalis | Clostridium_symbiosum | −− |
| SPC10197 | SPC10355 | Ruminococcus_obeum | Clostridium_symbiosum | ++++ |
| SPC10233 | SPC10355 | Ruminococcus_torques | Clostridium_symbiosum | ++ |
| SPC00015 | SPC10355 | Streptococcus_thermophilus | Clostridium_symbiosum | |
| SPC10167 | SPC10155 | Clostridium_disporicum | Clostridium_tertium | ++++ |
| SPC10155 | SPC10155 | Clostridium_tertium | Clostridium_tertium | ++++ |
| SPC10097 | SPC10155 | Collinsella_aerofaciens | Clostridium_tertium | |
| SPC10030 | SPC10097 | Bacteroides_ovatus | Collinsella_aerofaciens | ++++ |
| SPC00006 | SPC10097 | Bacteroides_sp_1_1_6 | Collinsella_aerofaciens | ++++ |
| SPC00007 | SPC10097 | Bacteroides_sp_3_1_23 | Collinsella_aerofaciens | ++++ |
| SPC10019 | SPC10097 | Bacteroides_sp_D20 | Collinsella_aerofaciens | ++++ |
| SPC00005 | SPC10097 | Bacteroides_vulgatus | Collinsella_aerofaciens | ++++ |
| SPC10081 | SPC10097 | Bacteroides_vulgatus | Collinsella_aerofaciens | ++++ |
| SPC00021 | SPC10097 | Blautia_producta | Collinsella_aerofaciens | ++++ |
| SPC00026 | SPC10097 | Clostridium_nexile | Collinsella_aerofaciens | + |
| SPC00027 | SPC10097 | Clostridium_sp_HGF2 | Collinsella_aerofaciens | ++++ |
| SPC10155 | SPC10097 | Clostridium_tertium | Collinsella_aerofaciens | |
| SPC10097 | SPC10097 | Collinsella_aerofaciens | Collinsella_aerofaciens | ++++ |
| SPC10097 | SPC10097 | Collinsella_aerofaciens | Collinsella_aerofaciens | |
| SPC00009 | SPC10097 | Coprobacillus_sp_D7 | Collinsella_aerofaciens | +++ |
| SPC00080 | SPC10097 | Coprococcus_catus | Collinsella_aerofaciens | ++++ |
| SPC00018 | SPC10097 | Dorea_formicigenerans | Collinsella_aerofaciens | ++ |
| SPC00057 | SPC10097 | Dorea_longicatena | Collinsella_aerofaciens | ++++ |
| SPC00008 | SPC10097 | Enterococcus_faecalis | Collinsella_aerofaciens | ++++ |
| SPC10001 | SPC10097 | Erysipelotrichaceae_bacterium | Collinsella_aerofaciens | ++++ |
| SPC00001 | SPC10097 | Escherichia_coli | Collinsella_aerofaciens | ++++ |
| SPC00022 | SPC10097 | Eubacterium_eligens | Collinsella_aerofaciens | +++ |
| SPC00054 | SPC10097 | Faecalibacterium_prausnitzii | Collinsella_aerofaciens | +++ |
| SPC00056 | SPC10097 | Odoribacter_splanchnicus | Collinsella_aerofaciens | +++ |
| SPC10048 | SPC10097 | Parabacteroides_merdae | Collinsella_aerofaciens | ++++ |
| SPC00061 | SPC10097 | Roseburia_intestinalis | Collinsella_aerofaciens | ++ |
| SPC00015 | SPC10097 | Streptococcus_thermophilus | Collinsella_aerofaciens | + |
| SPC00006 | SPC00009 | Bacteroides_sp_1_1_6 | Coprobacillus_sp_D7 | +++ |
| SPC00007 | SPC00009 | Bacteroides_sp_3_1_23 | Coprobacillus_sp_D7 | |
| SPC00005 | SPC00009 | Bacteroides_vulgatus | Coprobacillus_sp_D7 | + |
| SPC00009 | SPC00009 | Coprobacillus_sp_D7 | Coprobacillus_sp_D7 | − |
| SPC00008 | SPC00009 | Enterococcus_faecalis | Coprobacillus_sp_D7 | ++++ |
| SPC00001 | SPC00009 | Escherichia_coli | Coprobacillus_sp_D7 | ++ |
| SPC00006 | SPC00080 | Bacteroides_sp_1_1_6 | Coprococcus_catus | ++++ |
| SPC00007 | SPC00080 | Bacteroides_sp_3_1_23 | Coprococcus_catus | |
| SPC00005 | SPC00080 | Bacteroides_vulgatus | Coprococcus_catus | + |
| SPC00021 | SPC00080 | Blautia_producta | Coprococcus_catus | ++++ |

TABLE 9-continued

| SPC1 | SPC2 | OTU1 | OTU2 | Result |
|---|---|---|---|---|
| SPC00026 | SPC00080 | Clostridium_nexile | Coprococcus_catus | |
| SPC00027 | SPC00080 | Clostridium_sp_HGF2 | Coprococcus_catus | --- |
| SPC00009 | SPC00080 | Coprobacillus_sp_D7 | Coprococcus_catus | --- |
| SPC00080 | SPC00080 | Coprococcus_catus | Coprococcus_catus | |
| SPC00018 | SPC00080 | Dorea_formicigenerans | Coprococcus_catus | |
| SPC00057 | SPC00080 | Dorea_longicatena | Coprococcus_catus | |
| SPC00008 | SPC00080 | Enterococcus_faecalis | Coprococcus_catus | ++++ |
| SPC00001 | SPC00080 | Escherichia_coli | Coprococcus_catus | ++++ |
| SPC00022 | SPC00080 | Eubacterium_eligens | Coprococcus_catus | |
| SPC00054 | SPC00080 | Faecalibacterium_prausnitzii | Coprococcus_catus | |
| SPC00056 | SPC00080 | Odoribacter_splanchnicus | Coprococcus_catus | |
| SPC00061 | SPC00080 | Roseburia_intestinalis | Coprococcus_catus | |
| SPC00015 | SPC00080 | Streptococcus_thermophilus | Coprococcus_catus | |
| SPC10211 | SPC10304 | Bacteroides_caccae | Coprococcus_comes | +++ |
| SPC10213 | SPC10304 | Bacteroides_eggerthii | Coprococcus_comes | +++ |
| SPC10030 | SPC10304 | Bacteroides_ovatus | Coprococcus_comes | |
| SPC00006 | SPC10304 | Bacteroides_sp_1_1_6 | Coprococcus_comes | +++ |
| SPC00007 | SPC10304 | Bacteroides_sp_3_1_23 | Coprococcus_comes | ++++ |
| SPC10019 | SPC10304 | Bacteroides_sp_D20 | Coprococcus_comes | |
| SPC00005 | SPC10304 | Bacteroides_vulgatus | Coprococcus_comes | ++++ |
| SPC10081 | SPC10304 | Bacteroides_vulgatus | Coprococcus_comes | |
| SPC10301 | SPC10304 | Bifidobacterium_adolescentis | Coprococcus_comes | ++++ |
| SPC10298 | SPC10304 | Bifidobacterium_pseudocatenulatum | Coprococcus_comes | ++++ |
| SPC00021 | SPC10304 | Blautia_producta | Coprococcus_comes | ++++ |
| SPC10256 | SPC10304 | Clostridium_butyricum | Coprococcus_comes | ++++ |
| SPC10167 | SPC10304 | Clostridium_disporicum | Coprococcus_comes | ++++ |
| SPC10243 | SPC10304 | Clostridium_hathewayi | Coprococcus_comes | ++++ |
| SPC10313 | SPC10304 | Clostridium_hylemonae | Coprococcus_comes | + |
| SPC10202 | SPC10304 | Clostridium_innocuum | Coprococcus_comes | ++++ |
| SPC10238 | SPC10304 | Clostridium_mayombei | Coprococcus_comes | ++++ |
| SPC00026 | SPC10304 | Clostridium_nexile | Coprococcus_comes | |
| SPC00027 | SPC10304 | Clostridium_sp_HGF2 | Coprococcus_comes | |
| SPC10155 | SPC10304 | Clostridium_tertium | Coprococcus_comes | ++++ |
| SPC10097 | SPC10304 | Collinsella_aerofaciens | Coprococcus_comes | ++++ |
| SPC10097 | SPC10304 | Collinsella_aerofaciens | Coprococcus_comes | +++ |
| SPC00009 | SPC10304 | Coprobacillus_sp_D7 | Coprococcus_comes | +++ |
| SPC00080 | SPC10304 | Coprococcus_catus | Coprococcus_comes | -- |
| SPC10304 | SPC10304 | Coprococcus_comes | Coprococcus_comes | |
| SPC10304 | SPC10304 | Coprococcus_comes | Coprococcus_comes | ++ |
| SPC00018 | SPC10304 | Dorea_formicigenerans | Coprococcus_comes | |
| SPC00057 | SPC10304 | Dorea_longicatena | Coprococcus_comes | |
| SPC00008 | SPC10304 | Enterococcus_faecalis | Coprococcus_comes | ++++ |
| SPC10001 | SPC10304 | Erysipelotrichaceae_bacterium | Coprococcus_comes | − |
| SPC00001 | SPC10304 | Escherichia_coli | Coprococcus_comes | ++++ |
| SPC10110 | SPC10304 | Escherichia_coli | Coprococcus_comes | ++++ |
| SPC00022 | SPC10304 | Eubacterium_eligens | Coprococcus_comes | ++ |
| SPC00054 | SPC10304 | Faecalibacterium_prausnitzii | Coprococcus_comes | |
| SPC00056 | SPC10304 | Odoribacter_splanchnicus | Coprococcus_comes | |
| SPC10048 | SPC10304 | Parabacteroides_merdae | Coprococcus_comes | − |
| SPC00061 | SPC10304 | Roseburia_intestinalis | Coprococcus_comes | − |
| SPC10197 | SPC10304 | Ruminococcus_obeum | Coprococcus_comes | ++++ |
| SPC10233 | SPC10304 | Ruminococcus_torques | Coprococcus_comes | ++++ |
| SPC00015 | SPC10304 | Streptococcus_thermophilus | Coprococcus_comes | ++ |
| SPC00006 | SPC00018 | Bacteroides_sp_1_1_6 | Dorea_formicigenerans | +++ |
| SPC00007 | SPC00018 | Bacteroides_sp_3_1_23 | Dorea_formicigenerans | |
| SPC00005 | SPC00018 | Bacteroides_vulgatus | Dorea_formicigenerans | ++ |
| SPC00009 | SPC00018 | Coprobacillus_sp_D7 | Dorea_formicigenerans | − |
| SPC00018 | SPC00018 | Dorea_formicigenerans | Dorea_formicigenerans | -- |
| SPC00008 | SPC00018 | Enterococcus_faecalis | Dorea_formicigenerans | ++++ |
| SPC00001 | SPC00018 | Escherichia_coli | Dorea_formicigenerans | ++ |
| SPC00015 | SPC00018 | Streptococcus_thermophilus | Dorea_formicigenerans | |
| SPC00006 | SPC00057 | Bacteroides_sp_1_1_6 | Dorea_longicatena | ++++ |
| SPC00007 | SPC00057 | Bacteroides_sp_3_1_23 | Dorea_longicatena | +++ |
| SPC00005 | SPC00057 | Bacteroides_vulgatus | Dorea_longicatena | ++++ |
| SPC00021 | SPC00057 | Blautia_producta | Dorea_longicatena | ++++ |
| SPC00026 | SPC00057 | Clostridium_nexile | Dorea_longicatena | |
| SPC00027 | SPC00057 | Clostridium_sp_HGF2 | Dorea_longicatena | -- |
| SPC00009 | SPC00057 | Coprobacillus_sp_D7 | Dorea_longicatena | |
| SPC00018 | SPC00057 | Dorea_formicigenerans | Dorea_longicatena | ++ |
| SPC00057 | SPC00057 | Dorea_longicatena | Dorea_longicatena | − |
| SPC00008 | SPC00057 | Enterococcus_faecalis | Dorea_longicatena | ++++ |
| SPC00001 | SPC00057 | Escherichia_coli | Dorea_longicatena | ++++ |
| SPC00022 | SPC00057 | Eubacterium_eligens | Dorea_longicatena | ++ |
| SPC00054 | SPC00057 | Faecalibacterium_prausnitzii | Dorea_longicatena | − |
| SPC00056 | SPC00057 | Odoribacter_splanchnicus | Dorea_longicatena | |
| SPC00015 | SPC00057 | Streptococcus_thermophilus | Dorea_longicatena | + |
| SPC00006 | SPC00008 | Bacteroides_sp_1_1_6 | Enterococcus_faecalis | ++++ |
| SPC00007 | SPC00008 | Bacteroides_sp_3_1_23 | Enterococcus_faecalis | ++++ |

TABLE 9-continued

| SPC1 | SPC2 | OTU1 | OTU2 | Result |
|---|---|---|---|---|
| SPC00005 | SPC00008 | Bacteroides_vulgatus | Enterococcus_faecalis | ++++ |
| SPC00008 | SPC00008 | Enterococcus_faecalis | Enterococcus_faecalis | ++++ |
| SPC00001 | SPC00008 | Escherichia_coli | Enterococcus_faecalis | ++++ |
| SPC00006 | SPC10001 | Bacteroides_sp_1_1_6 | Erysipelotrichaceae_bacterium | ++++ |
| SPC00007 | SPC10001 | Bacteroides_sp_3_1_23 | Erysipelotrichaceae_bacterium | |
| SPC00005 | SPC10001 | Bacteroides_vulgatus | Erysipelotrichaceae_bacterium | + |
| SPC00021 | SPC10001 | Blautia_producta | Erysipelotrichaceae_bacterium | ++++ |
| SPC00026 | SPC10001 | Clostridium_nexile | Erysipelotrichaceae_bacterium | |
| SPC00027 | SPC10001 | Clostridium_sp_HGF2 | Erysipelotrichaceae_bacterium | -- |
| SPC00009 | SPC10001 | Coprobacillus_sp_D7 | Erysipelotrichaceae_bacterium | - |
| SPC00080 | SPC10001 | Coprococcus_catus | Erysipelotrichaceae_bacterium | |
| SPC00018 | SPC10001 | Dorea_formicigenerans | Erysipelotrichaceae_bacterium | -- |
| SPC00057 | SPC10001 | Dorea_longicatena | Erysipelotrichaceae_bacterium | |
| SPC00008 | SPC10001 | Enterococcus_faecalis | Erysipelotrichaceae_bacterium | ++++ |
| SPC10001 | SPC10001 | Erysipelotrichaceae_bacterium | Erysipelotrichaceae_bacterium | - |
| SPC00001 | SPC10001 | Escherichia_coli | Erysipelotrichaceae_bacterium | ++++ |
| SPC00022 | SPC10001 | Eubacterium_eligens | Erysipelotrichaceae_bacterium | - |
| SPC00054 | SPC10001 | Faecalibacterium_prausnitzii | Erysipelotrichaceae_bacterium | - |
| SPC00056 | SPC10001 | Odoribacter_splanchnicus | Erysipelotrichaceae_bacterium | |
| SPC00061 | SPC10001 | Roseburia_intestinalis | Erysipelotrichaceae_bacterium | - |
| SPC00015 | SPC10001 | Streptococcus_thermophilus | Erysipelotrichaceae_bacterium | |
| SPC10030 | SPC10110 | Bacteroides_ovatus | Escherichia_coli | ++++ |
| SPC00006 | SPC10110 | Bacteroides_sp_1_1_6 | Escherichia_coli | ++++ |
| SPC00007 | SPC10110 | Bacteroides_sp_3_1_23 | Escherichia_coli | ++++ |
| SPC10019 | SPC10110 | Bacteroides_sp_D20 | Escherichia_coli | ++++ |
| SPC00005 | SPC10110 | Bacteroides_vulgatus | Escherichia_coli | ++++ |
| SPC10081 | SPC10110 | Bacteroides_vulgatus | Escherichia_coli | ++++ |
| SPC00021 | SPC10110 | Blautia_producta | Escherichia_coli | ++++ |
| SPC00026 | SPC10110 | Clostridium_nexile | Escherichia_coli | ++++ |
| SPC00027 | SPC10110 | Clostridium_sp_HGF2 | Escherichia_coli | ++++ |
| SPC10097 | SPC10110 | Collinsella_aerofaciens | Escherichia_coli | ++++ |
| SPC00009 | SPC10110 | Coprobacillus_sp_D7 | Escherichia_coli | ++ |
| SPC00080 | SPC10110 | Coprococcus_catus | Escherichia_coli | ++++ |
| SPC00018 | SPC10110 | Dorea_formicigenerans | Escherichia_coli | ++++ |
| SPC00057 | SPC10110 | Dorea_longicatena | Escherichia_coli | ++++ |
| SPC00008 | SPC10110 | Enterococcus_faecalis | Escherichia_coli | ++++ |
| SPC10001 | SPC10110 | Erysipelotrichaceae_bacterium | Escherichia_coli | ++++ |
| SPC00001 | SPC00001 | Escherichia_coli | Escherichia_coli | ++++ |
| SPC00001 | SPC10110 | Escherichia_coli | Escherichia_coli | ++++ |
| SPC10110 | SPC10110 | Escherichia_coli | Escherichia_coli | ++++ |
| SPC00022 | SPC10110 | Eubacterium_eligens | Escherichia_coli | ++++ |
| SPC00054 | SPC10110 | Faecalibacterium_prausnitzii | Escherichia_coli | +++ |
| SPC00056 | SPC10110 | Odoribacter_splanchnicus | Escherichia_coli | +++ |
| SPC10048 | SPC10110 | Parabacteroides_merdae | Escherichia_coli | ++++ |
| SPC00061 | SPC10110 | Roseburia_intestinalis | Escherichia_coli | +++ |
| SPC00015 | SPC10110 | Streptococcus_thermophilus | Escherichia_coli | +++ |
| SPC00006 | SPC00022 | Bacteroides_sp_1_1_6 | Eubacterium_eligens | ++++ |
| SPC00007 | SPC00022 | Bacteroides_sp_3_1_23 | Eubacterium_eligens | |
| SPC00005 | SPC00022 | Bacteroides_vulgatus | Eubacterium_eligens | +++ |
| SPC00021 | SPC00022 | Blautia_producta | Eubacterium_eligens | ++++ |
| SPC00009 | SPC00022 | Coprobacillus_sp_D7 | Eubacterium_eligens | |
| SPC00018 | SPC00022 | Dorea_formicigenerans | Eubacterium_eligens | -- |
| SPC00008 | SPC00022 | Enterococcus_faecalis | Eubacterium_eligens | ++++ |
| SPC00001 | SPC00022 | Escherichia_coli | Eubacterium_eligens | ++ |
| SPC00022 | SPC00022 | Eubacterium_eligens | Eubacterium_eligens | |
| SPC00015 | SPC00022 | Streptococcus_thermophilus | Eubacterium_eligens | |
| SPC10211 | SPC10363 | Bacteroides_caccae | Eubacterium_rectale | |
| SPC10213 | SPC10363 | Bacteroides_eggerthii | Eubacterium_rectale | |
| SPC10030 | SPC10363 | Bacteroides_ovatus | Eubacterium_rectale | |
| SPC00006 | SPC10363 | Bacteroides_sp_1_1_6 | Eubacterium_rectale | ++++ |
| SPC00007 | SPC10363 | Bacteroides_sp_3_1_23 | Eubacterium_rectale | +++ |
| SPC10019 | SPC10363 | Bacteroides_sp_D20 | Eubacterium_rectale | -- |
| SPC00005 | SPC10363 | Bacteroides_vulgatus | Eubacterium_rectale | ++++ |
| SPC10081 | SPC10363 | Bacteroides_vulgatus | Eubacterium_rectale | |
| SPC10301 | SPC10363 | Bifidobacterium_adolescentis | Eubacterium_rectale | ++++ |
| SPC10298 | SPC10363 | Bifidobacterium_pseudocatenulatum | Eubacterium_rectale | |
| SPC00021 | SPC10363 | Blautia_producta | Eubacterium_rectale | ++++ |
| SPC10415 | SPC10567 | Blautia_producta | Eubacterium_rectale | ++++ |
| SPC10256 | SPC10567 | Clostridium_butyricum | Eubacterium_rectale | ++++ |
| SPC10358 | SPC10567 | Clostridium_orbiscindens | Eubacterium_rectale | + |
| SPC10325 | SPC10567 | Clostridium_bolteae | Eubacterium_rectale | ++ |
| SPC10167 | SPC10567 | Clostridium_disporicum | Eubacterium_rectale | ++++ |
| SPC10243 | SPC10363 | Clostridium_hathewayi | Eubacterium_rectale | ++++ |
| SPC10313 | SPC10567 | Clostridium_hylemonae | Eubacterium_rectale | |
| SPC10202 | SPC10567 | Clostridium_innocuum | Eubacterium_rectale | ++++ |
| SPC10238 | SPC10567 | Clostridium_mayombei | Eubacterium_rectale | ++++ |
| SPC00026 | SPC10363 | Clostridium_nexile | Eubacterium_rectale | - |
| SPC00027 | SPC10363 | Clostridium_sp_HGF2 | Eubacterium_rectale | -- |

TABLE 9-continued

| SPC1 | SPC2 | OTU1 | OTU2 | Result |
|---|---|---|---|---|
| SPC10355 | SPC10363 | Clostridium_symbiosum | Eubacterium_rectale | ++ |
| SPC10355 | SPC10567 | Clostridium_symbiosum | Eubacterium_rectale | + |
| SPC10155 | SPC10567 | Clostridium_tertium | Eubacterium_rectale | ++++ |
| SPC10097 | SPC10363 | Collinsella_aerofaciens | Eubacterium_rectale | ++++ |
| SPC10097 | SPC10567 | Collinsella_aerofaciens | Eubacterium_rectale | ++++ |
| SPC00009 | SPC10363 | Coprobacillus_sp_D7 | Eubacterium_rectale | +++ |
| SPC00080 | SPC10363 | Coprococcus_catus | Eubacterium_rectale | --- |
| SPC10304 | SPC10363 | Coprococcus_comes | Eubacterium_rectale | + |
| SPC10304 | SPC10567 | Coprococcus_comes | Eubacterium_rectale | ++++ |
| SPC00018 | SPC10363 | Dorea_formicigenerans | Eubacterium_rectale | − |
| SPC00057 | SPC10363 | Dorea_longicatena | Eubacterium_rectale | ++++ |
| SPC00008 | SPC10363 | Enterococcus_faecalis | Eubacterium_rectale | ++++ |
| SPC10001 | SPC10363 | Erysipelotrichaceae_bacterium | Eubacterium_rectale | − |
| SPC00001 | SPC10363 | Escherichia_coli | Eubacterium_rectale | ++++ |
| SPC10110 | SPC10363 | Escherichia_coli | Eubacterium_rectale | ++++ |
| SPC00022 | SPC10363 | Eubacterium_eligens | Eubacterium_rectale | |
| SPC10363 | SPC10363 | Eubacterium_rectale | Eubacterium_rectale | +++ |
| SPC10567 | SPC10567 | Eubacterium_rectale | Eubacterium_rectale | |
| SPC00054 | SPC10363 | Faecalibacterium_prausnitzii | Eubacterium_rectale | −− |
| SPC10386 | SPC10567 | Faecalibacterium_prausnitzii | Eubacterium_rectale | |
| SPC10390 | SPC10567 | Lachnospiraceae_bacterium_5_1_57FAA | Eubacterium_rectale | +++ |
| SPC00056 | SPC10363 | Odoribacter_splanchnicus | Eubacterium_rectale | − |
| SPC10048 | SPC10363 | Parabacteroides_merdae | Eubacterium_rectale | − |
| SPC00061 | SPC10363 | Roseburia_intestinalis | Eubacterium_rectale | ---- |
| SPC10470 | SPC10567 | Ruminococcus_bromii | Eubacterium_rectale | + |
| SPC10468 | SPC10567 | Ruminococcus_gnavus | Eubacterium_rectale | ++++ |
| SPC10197 | SPC10363 | Ruminococcus_obeum | Eubacterium_rectale | ++ |
| SPC10233 | SPC10363 | Ruminococcus_torques | Eubacterium_rectale | + |
| SPC00015 | SPC10363 | Streptococcus_thermophilus | Eubacterium_rectale | |
| SPC10211 | SPC10386 | Bacteroides_caccae | Faecalibacterium_prausnitzii | |
| SPC10213 | SPC10386 | Bacteroides_eggerthii | Faecalibacterium_prausnitzii | − |
| SPC10030 | SPC10386 | Bacteroides_ovatus | Faecalibacterium_prausnitzii | − |
| SPC00006 | SPC00054 | Bacteroides_sp_1_1_6 | Faecalibacterium_prausnitzii | ++++ |
| SPC00006 | SPC10386 | Bacteroides_sp_1_1_6 | Faecalibacterium_prausnitzii | +++ |
| SPC00007 | SPC00054 | Bacteroides_sp_3_1_23 | Faecalibacterium_prausnitzii | ++ |
| SPC00007 | SPC10386 | Bacteroides_sp_3_1_23 | Faecalibacterium_prausnitzii | |
| SPC10019 | SPC10386 | Bacteroides_sp_D20 | Faecalibacterium_prausnitzii | −− |
| SPC00005 | SPC00054 | Bacteroides_vulgatus | Faecalibacterium_prausnitzii | ++++ |
| SPC00005 | SPC10386 | Bacteroides_vulgatus | Faecalibacterium_prausnitzii | +++ |
| SPC10081 | SPC10386 | Bacteroides_vulgatus | Faecalibacterium_prausnitzii | --- |
| SPC10301 | SPC10386 | Bifidobacterium_adolescentis | Faecalibacterium_prausnitzii | + |
| SPC10298 | SPC10386 | Bifidobacterium_pseudocatenulatum | Faecalibacterium_prausnitzii | |
| SPC00021 | SPC00054 | Blautia_producta | Faecalibacterium_prausnitzii | ++++ |
| SPC00021 | SPC10386 | Blautia_producta | Faecalibacterium_prausnitzii | ++++ |
| SPC10256 | SPC10386 | Clostridium_butyricum | Faecalibacterium_prausnitzii | ++++ |
| SPC10358 | SPC10386 | Clostridium_orbiscindens | Faecalibacterium_prausnitzii | |
| SPC10325 | SPC10386 | Clostridium_bolteae | Faecalibacterium_prausnitzii | ++ |
| SPC10167 | SPC10386 | Clostridium_disporicum | Faecalibacterium_prausnitzii | |
| SPC10243 | SPC10386 | Clostridium_hathewayi | Faecalibacterium_prausnitzii | +++ |
| SPC10313 | SPC10386 | Clostridium_hylemonae | Faecalibacterium_prausnitzii | |
| SPC10202 | SPC10386 | Clostridium_innocuum | Faecalibacterium_prausnitzii | ++++ |
| SPC10238 | SPC10386 | Clostridium_mayombei | Faecalibacterium_prausnitzii | ++++ |
| SPC00026 | SPC00054 | Clostridium_nexile | Faecalibacterium_prausnitzii | |
| SPC00026 | SPC10386 | Clostridium_nexile | Faecalibacterium_prausnitzii | − |
| SPC00027 | SPC00054 | Clostridium_sp_HGF2 | Faecalibacterium_prausnitzii | ++ |
| SPC00027 | SPC10386 | Clostridium_sp_HGF2 | Faecalibacterium_prausnitzii | −− |
| SPC10355 | SPC10386 | Clostridium_symbiosum | Faecalibacterium_prausnitzii | +++ |
| SPC10355 | SPC10386 | Clostridium_symbiosum | Faecalibacterium_prausnitzii | ++++ |
| SPC10155 | SPC10386 | Clostridium_tertium | Faecalibacterium_prausnitzii | ++++ |
| SPC10097 | SPC10386 | Collinsella_aerofaciens | Faecalibacterium_prausnitzii | ++++ |
| SPC10097 | SPC10386 | Collinsella_aerofaciens | Faecalibacterium_prausnitzii | ++++ |
| SPC00009 | SPC00054 | Coprobacillus_sp_D7 | Faecalibacterium_prausnitzii | --- |
| SPC00009 | SPC10386 | Coprobacillus_sp_D7 | Faecalibacterium_prausnitzii | |
| SPC00080 | SPC10386 | Coprococcus_catus | Faecalibacterium_prausnitzii | --- |
| SPC10304 | SPC10386 | Coprococcus_comes | Faecalibacterium_prausnitzii | |
| SPC10304 | SPC10386 | Coprococcus_comes | Faecalibacterium_prausnitzii | +++ |
| SPC00018 | SPC00054 | Dorea_formicigenerans | Faecalibacterium_prausnitzii | |
| SPC00018 | SPC10386 | Dorea_formicigenerans | Faecalibacterium_prausnitzii | --- |
| SPC00057 | SPC10386 | Dorea_longicatena | Faecalibacterium_prausnitzii | +++ |
| SPC00008 | SPC00054 | Enterococcus_faecalis | Faecalibacterium_prausnitzii | ++++ |
| SPC00008 | SPC10386 | Enterococcus_faecalis | Faecalibacterium_prausnitzii | ++++ |
| SPC10001 | SPC10386 | Erysipelotrichaceae_bacterium | Faecalibacterium_prausnitzii | −− |
| SPC00001 | SPC00054 | Escherichia_coli | Faecalibacterium_prausnitzii | ++++ |
| SPC00001 | SPC10386 | Escherichia_coli | Faecalibacterium_prausnitzii | ++++ |
| SPC10110 | SPC10386 | Escherichia_coli | Faecalibacterium_prausnitzii | ++ |
| SPC00022 | SPC00054 | Eubacterium_eligens | Faecalibacterium_prausnitzii | |
| SPC00022 | SPC10386 | Eubacterium_eligens | Faecalibacterium_prausnitzii | |
| SPC10363 | SPC10386 | Eubacterium_rectale | Faecalibacterium_prausnitzii | + |

TABLE 9-continued

| SPC1 | SPC2 | OTU1 | OTU2 | Result |
|---|---|---|---|---|
| SPC00054 | SPC00054 | Faecalibacterium_prausnitzii | Faecalibacterium_prausnitzii | + |
| SPC00054 | SPC10386 | Faecalibacterium_prausnitzii | Faecalibacterium_prausnitzii | |
| SPC10386 | SPC10386 | Faecalibacterium_prausnitzii | Faecalibacterium_prausnitzii | + |
| SPC10386 | SPC10386 | Faecalibacterium_prausnitzii | Faecalibacterium_prausnitzii | |
| SPC10390 | SPC10386 | Lachnospiraceae_bacterium_5_1_57FAA | Faecalibacterium_prausnitzii | ++++ |
| SPC00056 | SPC10386 | Odoribacter_splanchnicus | Faecalibacterium_prausnitzii | -- |
| SPC10048 | SPC10386 | Parabacteroides_merdae | Faecalibacterium_prausnitzii | - |
| SPC00061 | SPC10386 | Roseburia_intestinalis | Faecalibacterium_prausnitzii | |
| SPC10197 | SPC10386 | Ruminococcus_obeum | Faecalibacterium_prausnitzii | |
| SPC10233 | SPC10386 | Ruminococcus_torques | Faecalibacterium_prausnitzii | |
| SPC00015 | SPC00054 | Streptococcus_thermophilus | Faecalibacterium_prausnitzii | |
| SPC00015 | SPC10386 | Streptococcus_thermophilus | Faecalibacterium_prausnitzii | |
| SPC10211 | SPC10390 | Bacteroides_caccae | Lachnospiraceae_bacterium_5_1_57FAA | |
| SPC10213 | SPC10390 | Bacteroides_eggerthii | Lachnospiraceae_bacterium_5_1_57FAA | |
| SPC10030 | SPC10390 | Bacteroides_ovatus | Lachnospiraceae_bacterium_5_1_57FAA | - |
| SPC00006 | SPC10390 | Bacteroides_sp_1_1_6 | Lachnospiraceae_bacterium_5_1_57FAA | +++ |
| SPC00007 | SPC10390 | Bacteroides_sp_3_1_23 | Lachnospiraceae_bacterium_5_1_57FAA | |
| SPC10019 | SPC10390 | Bacteroides_sp_D20 | Lachnospiraceae_bacterium_5_1_57FAA | --- |
| SPC00005 | SPC10390 | Bacteroides_vulgatus | Lachnospiraceae_bacterium_5_1_57FAA | +++ |
| SPC10081 | SPC10390 | Bacteroides_vulgatus | Lachnospiraceae_bacterium_5_1_57FAA | -- |
| SPC10301 | SPC10390 | Bifidobacterium_adolescentis | Lachnospiraceae_bacterium_5_1_57FAA | ++++ |
| SPC10298 | SPC10390 | Bifidobacterium_pseudocatenulatum | Lachnospiraceae_bacterium_5_1_57FAA | |
| SPC00021 | SPC10390 | Blautia_producta | Lachnospiraceae_bacterium_5_1_57FAA | ++++ |
| SPC10415 | SPC10390 | Blautia_producta | Lachnospiraceae_bacterium_5_1_57FAA | ++++ |
| SPC10256 | SPC10390 | Clostridium_butyricum | Lachnospiraceae_bacterium_5_1_57FAA | ++++ |
| SPC10358 | SPC10390 | Clostridium_orbiscindens | Lachnospiraceae_bacterium_5_1_57FAA | ++++ |
| SPC10325 | SPC10390 | Clostridium_bolteae | Lachnospiraceae_bacterium_5_1_57FAA | ++++ |
| SPC10167 | SPC10390 | Clostridium_disporicum | Lachnospiraceae_bacterium_5_1_57FAA | ++++ |
| SPC10243 | SPC10390 | Clostridium_hathewayi | Lachnospiraceae_bacterium_5_1_57FAA | ++++ |
| SPC10313 | SPC10390 | Clostridium_hylemonae | Lachnospiraceae_bacterium_5_1_57FAA | ++++ |
| SPC10202 | SPC10390 | Clostridium_innocuum | Lachnospiraceae_bacterium_5_1_57FAA | ++++ |
| SPC10238 | SPC10390 | Clostridium_mayombei | Lachnospiraceae_bacterium_5_1_57FAA | ++++ |
| SPC00026 | SPC10390 | Clostridium_nexile | Lachnospiraceae_bacterium_5_1_57FAA | - |
| SPC00027 | SPC10390 | Clostridium_sp_HGF2 | Lachnospiraceae_bacterium_5_1_57FAA | - |
| SPC10355 | SPC10390 | Clostridium_symbiosum | Lachnospiraceae_bacterium_5_1_57FAA | + |
| SPC10355 | SPC10390 | Clostridium_symbiosum | Lachnospiraceae_bacterium_5_1_57FAA | ++++ |
| SPC10155 | SPC10390 | Clostridium_tertium | Lachnospiraceae_bacterium_5_1_57FAA | ++++ |
| SPC10097 | SPC10390 | Collinsella_aerofaciens | Lachnospiraceae_bacterium_5_1_57FAA | ++++ |
| SPC10097 | SPC10390 | Collinsella_aerofaciens | Lachnospiraceae_bacterium_5_1_57FAA | ++++ |
| SPC00009 | SPC10390 | Coprobacillus_sp_D7 | Lachnospiraceae_bacterium_5_1_57FAA | ++++ |
| SPC00080 | SPC10390 | Coprococcus_catus | Lachnospiraceae_bacterium_5_1_57FAA | |
| SPC10304 | SPC10390 | Coprococcus_comes | Lachnospiraceae_bacterium_5_1_57FAA | |
| SPC10304 | SPC10390 | Coprococcus_comes | Lachnospiraceae_bacterium_5_1_57FAA | ++++ |
| SPC00018 | SPC10390 | Dorea_formicigenerans | Lachnospiraceae_bacterium_5_1_57FAA | -- |
| SPC00057 | SPC10390 | Dorea_longicatena | Lachnospiraceae_bacterium_5_1_57FAA | ++++ |
| SPC00008 | SPC10390 | Enterococcus_faecalis | Lachnospiraceae_bacterium_5_1_57FAA | ++++ |
| SPC10001 | SPC10390 | Erysipelotrichaceae_bacterium | Lachnospiraceae_bacterium_5_1_57FAA | --- |
| SPC00001 | SPC10390 | Escherichia_coli | Lachnospiraceae_bacterium_5_1_57FAA | ++++ |
| SPC10110 | SPC10390 | Escherichia_coli | Lachnospiraceae_bacterium_5_1_57FAA | ++++ |
| SPC00022 | SPC10390 | Eubacterium_eligens | Lachnospiraceae_bacterium_5_1_57FAA | |
| SPC10363 | SPC10390 | Eubacterium_rectale | Lachnospiraceae_bacterium_5_1_57FAA | |
| SPC00054 | SPC10390 | Faecalibacterium_prausnitzii | Lachnospiraceae_bacterium_5_1_57FAA | |
| SPC10386 | SPC10390 | Faecalibacterium_prausnitzii | Lachnospiraceae_bacterium_5_1_57FAA | |
| SPC10386 | SPC10390 | Faecalibacterium_prausnitzii | Lachnospiraceae_bacterium_5_1_57FAA | ++++ |
| SPC10390 | SPC10390 | Lachnospiraceae_bacterium_5_1_57FAA | Lachnospiraceae_bacterium_5_1_57FAA | |
| SPC10390 | SPC10390 | Lachnospiraceae_bacterium_5_1_57FAA | Lachnospiraceae_bacterium_5_1_57FAA | ++++ |
| SPC00056 | SPC10390 | Odoribacter_splanchnicus | Lachnospiraceae_bacterium_5_1_57FAA | -- |
| SPC10388 | SPC10390 | Odoribacter_splanchnicus | Lachnospiraceae_bacterium_5_1_57FAA | |
| SPC10048 | SPC10390 | Parabacteroides_merdae | Lachnospiraceae_bacterium_5_1_57FAA | - |
| SPC00061 | SPC10390 | Roseburia_intestinalis | Lachnospiraceae_bacterium_5_1_57FAA | |
| SPC10197 | SPC10390 | Ruminococcus_obeum | Lachnospiraceae_bacterium_5_1_57FAA | |
| SPC10233 | SPC10390 | Ruminococcus_torques | Lachnospiraceae_bacterium_5_1_57FAA | |
| SPC00015 | SPC10390 | Streptococcus_thermophilus | Lachnospiraceae_bacterium_5_1_57FAA | |
| SPC10211 | SPC10388 | Bacteroides_caccae | Odoribacter_splanchnicus | |
| SPC10213 | SPC10388 | Bacteroides_eggerthii | Odoribacter_splanchnicus | - |
| SPC10030 | SPC10388 | Bacteroides_ovatus | Odoribacter_splanchnicus | -- |
| SPC00006 | SPC00056 | Bacteroides_sp_1_1_6 | Odoribacter_splanchnicus | ++++ |
| SPC00006 | SPC10388 | Bacteroides_sp_1_1_6 | Odoribacter_splanchnicus | + |
| SPC00007 | SPC00056 | Bacteroides_sp_3_1_23 | Odoribacter_splanchnicus | + |
| SPC00007 | SPC10388 | Bacteroides_sp_3_1_23 | Odoribacter_splanchnicus | |
| SPC10019 | SPC10388 | Bacteroides_sp_D20 | Odoribacter_splanchnicus | --- |
| SPC00005 | SPC00056 | Bacteroides_vulgatus | Odoribacter_splanchnicus | +++ |
| SPC00005 | SPC10388 | Bacteroides_vulgatus | Odoribacter_splanchnicus | +++ |
| SPC10081 | SPC10388 | Bacteroides_vulgatus | Odoribacter_splanchnicus | - |
| SPC10301 | SPC10388 | Bifidobacterium_adolescentis | Odoribacter_splanchnicus | ++++ |
| SPC10298 | SPC10388 | Bifidobacterium_pseudocatenulatum | Odoribacter_splanchnicus | +++ |
| SPC00021 | SPC00056 | Blautia_producta | Odoribacter_splanchnicus | ++++ |
| SPC00021 | SPC10388 | Blautia_producta | Odoribacter_splanchnicus | ++++ |

TABLE 9-continued

| SPC1 | SPC2 | OTU1 | OTU2 | Result |
|---|---|---|---|---|
| SPC10243 | SPC10388 | Clostridium_hathewayi | Odoribacter_splanchnicus | ++++ |
| SPC00026 | SPC00056 | Clostridium_nexile | Odoribacter_splanchnicus | |
| SPC00026 | SPC10388 | Clostridium_nexile | Odoribacter_splanchnicus | --- |
| SPC00027 | SPC00056 | Clostridium_sp_HGF2 | Odoribacter_splanchnicus | |
| SPC00027 | SPC10388 | Clostridium_sp_HGF2 | Odoribacter_splanchnicus | --- |
| SPC10355 | SPC10388 | Clostridium_symbiosum | Odoribacter_splanchnicus | ++ |
| SPC10097 | SPC10388 | Collinsella_aerofaciens | Odoribacter_splanchnicus | ++++ |
| SPC00009 | SPC00056 | Coprobacillus_sp_D7 | Odoribacter_splanchnicus | − |
| SPC00009 | SPC10388 | Coprobacillus_sp_D7 | Odoribacter_splanchnicus | +++ |
| SPC00080 | SPC10388 | Coprococcus_catus | Odoribacter_splanchnicus | -- |
| SPC10304 | SPC10388 | Coprococcus_comes | Odoribacter_splanchnicus | |
| SPC00018 | SPC00056 | Dorea_formicigenerans | Odoribacter_splanchnicus | |
| SPC00018 | SPC10388 | Dorea_formicigenerans | Odoribacter_splanchnicus | − |
| SPC00057 | SPC10388 | Dorea_longicatena | Odoribacter_splanchnicus | ++++ |
| SPC00008 | SPC00056 | Enterococcus_faecalis | Odoribacter_splanchnicus | ++++ |
| SPC00008 | SPC10388 | Enterococcus_faecalis | Odoribacter_splanchnicus | ++++ |
| SPC10001 | SPC10388 | Erysipelotrichaceae_bacterium | Odoribacter_splanchnicus | -- |
| SPC00001 | SPC00056 | Escherichia_coli | Odoribacter_splanchnicus | ++++ |
| SPC00001 | SPC10388 | Escherichia_coli | Odoribacter_splanchnicus | ++++ |
| SPC10110 | SPC10388 | Escherichia_coli | Odoribacter_splanchnicus | ++++ |
| SPC00022 | SPC00056 | Eubacterium_eligens | Odoribacter_splanchnicus | |
| SPC00022 | SPC10388 | Eubacterium_eligens | Odoribacter_splanchnicus | |
| SPC10363 | SPC10388 | Eubacterium_rectale | Odoribacter_splanchnicus | + |
| SPC00054 | SPC00056 | Faecalibacterium_prausnitzii | Odoribacter_splanchnicus | |
| SPC00054 | SPC10388 | Faecalibacterium_prausnitzii | Odoribacter_splanchnicus | − |
| SPC10386 | SPC10388 | Faecalibacterium_prausnitzii | Odoribacter_splanchnicus | + |
| SPC00056 | SPC00056 | Odoribacter_splanchnicus | Odoribacter_splanchnicus | |
| SPC00056 | SPC10388 | Odoribacter_splanchnicus | Odoribacter_splanchnicus | --- |
| SPC10388 | SPC10388 | Odoribacter_splanchnicus | Odoribacter_splanchnicus | + |
| SPC10048 | SPC10388 | Parabacteroides_merdae | Odoribacter_splanchnicus | |
| SPC00061 | SPC10388 | Roseburia_intestinalis | Odoribacter_splanchnicus | |
| SPC10197 | SPC10388 | Ruminococcus_obeum | Odoribacter_splanchnicus | + |
| SPC10233 | SPC10388 | Ruminococcus_torques | Odoribacter_splanchnicus | |
| SPC00015 | SPC00056 | Streptococcus_thermophilus | Odoribacter_splanchnicus | |
| SPC00015 | SPC10388 | Streptococcus_thermophilus | Odoribacter_splanchnicus | + |
| SPC10030 | SPC10048 | Bacteroides_ovatus | Parabacteroides_merdae | |
| SPC00006 | SPC10048 | Bacteroides_sp_1_1_6 | Parabacteroides_merdae | ++++ |
| SPC00007 | SPC10048 | Bacteroides_sp_3_1_23 | Parabacteroides_merdae | +++ |
| SPC10019 | SPC10048 | Bacteroides_sp_D20 | Parabacteroides_merdae | |
| SPC00005 | SPC10048 | Bacteroides_vulgatus | Parabacteroides_merdae | ++++ |
| SPC00021 | SPC10048 | Blautia_producta | Parabacteroides_merdae | ++++ |
| SPC00026 | SPC10048 | Clostridium_nexile | Parabacteroides_merdae | ++ |
| SPC00027 | SPC10048 | Clostridium_sp_HGF2 | Parabacteroides_merdae | +++ |
| SPC00009 | SPC10048 | Coprobacillus_sp_D7 | Parabacteroides_merdae | − |
| SPC00080 | SPC10048 | Coprococcus_catus | Parabacteroides_merdae | +++ |
| SPC00018 | SPC10048 | Dorea_formicigenerans | Parabacteroides_merdae | |
| SPC00057 | SPC10048 | Dorea_longicatena | Parabacteroides_merdae | |
| SPC00008 | SPC10048 | Enterococcus_faecalis | Parabacteroides_merdae | ++++ |
| SPC10001 | SPC10048 | Erysipelotrichaceae_bacterium | Parabacteroides_merdae | |
| SPC00001 | SPC10048 | Escherichia_coli | Parabacteroides_merdae | ++++ |
| SPC00022 | SPC10048 | Eubacterium_eligens | Parabacteroides_merdae | |
| SPC00054 | SPC10048 | Faecalibacterium_prausnitzii | Parabacteroides_merdae | + |
| SPC00056 | SPC10048 | Odoribacter_splanchnicus | Parabacteroides_merdae | |
| SPC10048 | SPC10048 | Parabacteroides_merdae | Parabacteroides_merdae | +++ |
| SPC00061 | SPC10048 | Roseburia_intestinalis | Parabacteroides_merdae | |
| SPC00015 | SPC10048 | Streptococcus_thermophilus | Parabacteroides_merdae | |
| SPC00006 | SPC00061 | Bacteroides_sp_1_1_6 | Roseburia_intestinalis | ++++ |
| SPC00007 | SPC00061 | Bacteroides_sp_3_1_23 | Roseburia_intestinalis | + |
| SPC00005 | SPC00061 | Bacteroides_vulgatus | Roseburia_intestinalis | + |
| SPC00021 | SPC00061 | Blautia_producta | Roseburia_intestinalis | ++++ |
| SPC00026 | SPC00061 | Clostridium_nexile | Roseburia_intestinalis | − |
| SPC00027 | SPC00061 | Clostridium_sp_HGF2 | Roseburia_intestinalis | --- |
| SPC00009 | SPC00061 | Coprobacillus_sp_D7 | Roseburia_intestinalis | − |
| SPC00018 | SPC00061 | Dorea_formicigenerans | Roseburia_intestinalis | |
| SPC00057 | SPC00061 | Dorea_longicatena | Roseburia_intestinalis | − |
| SPC00008 | SPC00061 | Enterococcus_faecalis | Roseburia_intestinalis | ++++ |
| SPC00001 | SPC00061 | Escherichia_coli | Roseburia_intestinalis | ++++ |
| SPC00022 | SPC00061 | Eubacterium_eligens | Roseburia_intestinalis | |
| SPC00054 | SPC00061 | Faecalibacterium_prausnitzii | Roseburia_intestinalis | |
| SPC00056 | SPC00061 | Odoribacter_splanchnicus | Roseburia_intestinalis | − |
| SPC00061 | SPC00061 | Roseburia_intestinalis | Roseburia_intestinalis | |
| SPC00015 | SPC00061 | Streptococcus_thermophilus | Roseburia_intestinalis | |
| SPC10415 | SPC10470 | Blautia_producta | Ruminococcus_bromii | ++++ |
| SPC10256 | SPC10470 | Clostridium_butyricum | Ruminococcus_bromii | ++++ |
| SPC10358 | SPC10470 | Clostridium_orbiscindens | Ruminococcus_bromii | |
| SPC10325 | SPC10470 | Clostridium_bolteae | Ruminococcus_bromii | +++ |
| SPC10167 | SPC10470 | Clostridium_disporicum | Ruminococcus_bromii | |
| SPC10313 | SPC10470 | Clostridium_hylemonae | Ruminococcus_bromii | |

TABLE 9-continued

| SPC1 | SPC2 | OTU1 | OTU2 | Result |
|---|---|---|---|---|
| SPC10202 | SPC10470 | Clostridium_innocuum | Ruminococcus_bromii | ++++ |
| SPC10238 | SPC10470 | Clostridium_mayombei | Ruminococcus_bromii | ++++ |
| SPC10355 | SPC10470 | Clostridium_symbiosum | Ruminococcus_bromii | ++++ |
| SPC10155 | SPC10470 | Clostridium_tertium | Ruminococcus_bromii | ++++ |
| SPC10097 | SPC10470 | Collinsella_aerofaciens | Ruminococcus_bromii | ++++ |
| SPC10304 | SPC10470 | Coprococcus_comes | Ruminococcus_bromii | ++++ |
| SPC10567 | SPC10470 | Eubacterium_rectale | Ruminococcus_bromii | + |
| SPC10386 | SPC10470 | Faecalibacterium_prausnitzii | Ruminococcus_bromii | |
| SPC10390 | SPC10470 | Lachnospiraceae_bacterium_5_1_57FAA | Ruminococcus_bromii | ++++ |
| SPC10470 | SPC10470 | Ruminococcus_bromii | Ruminococcus_bromii | − |
| SPC10468 | SPC10470 | Ruminococcus_gnavus | Ruminococcus_bromii | ++++ |
| SPC10415 | SPC10468 | Blautia_producta | Ruminococcus_gnavus | ++++ |
| SPC10256 | SPC10468 | Clostridium_butyricum | Ruminococcus_gnavus | ++++ |
| SPC10358 | SPC10468 | Clostridium_orbiscindens | Ruminococcus_gnavus | ++++ |
| SPC10325 | SPC10468 | Clostridium_bolteae | Ruminococcus_gnavus | ++++ |
| SPC10167 | SPC10468 | Clostridium_disporicum | Ruminococcus_gnavus | ++++ |
| SPC10313 | SPC10468 | Clostridium_hylemonae | Ruminococcus_gnavus | +++ |
| SPC10202 | SPC10468 | Clostridium_innocuum | Ruminococcus_gnavus | ++++ |
| SPC10238 | SPC10468 | Clostridium_mayombei | Ruminococcus_gnavus | ++++ |
| SPC10355 | SPC10468 | Clostridium_symbiosum | Ruminococcus_gnavus | ++++ |
| SPC10155 | SPC10468 | Clostridium_tertium | Ruminococcus_gnavus | ++++ |
| SPC10097 | SPC10468 | Collinsella_aerofaciens | Ruminococcus_gnavus | ++++ |
| SPC10304 | SPC10468 | Coprococcus_comes | Ruminococcus_gnavus | ++++ |
| SPC10386 | SPC10468 | Faecalibacterium_prausnitzii | Ruminococcus_gnavus | ++++ |
| SPC10390 | SPC10468 | Lachnospiraceae_bacterium_5_1_57FAA | Ruminococcus_gnavus | ++++ |
| SPC10470 | SPC10468 | Ruminococcus_bromii | Ruminococcus_gnavus | ++++ |
| SPC10468 | SPC10468 | Ruminococcus_gnavus | Ruminococcus_gnavus | +++ |
| SPC10030 | SPC10197 | Bacteroides_ovatus | Ruminococcus_obeum | |
| SPC00006 | SPC10197 | Bacteroides_sp_1_1_6 | Ruminococcus_obeum | +++ |
| SPC00007 | SPC10197 | Bacteroides_sp_3_1_23 | Ruminococcus_obeum | +++ |
| SPC10019 | SPC10197 | Bacteroides_sp_D20 | Ruminococcus_obeum | |
| SPC00005 | SPC10197 | Bacteroides_vulgatus | Ruminococcus_obeum | ++++ |
| SPC10081 | SPC10197 | Bacteroides_vulgatus | Ruminococcus_obeum | |
| SPC00021 | SPC10197 | Blautia_producta | Ruminococcus_obeum | ++++ |
| SPC00026 | SPC10197 | Clostridium_nexile | Ruminococcus_obeum | − |
| SPC00027 | SPC10197 | Clostridium_sp_HGF2 | Ruminococcus_obeum | −− |
| SPC10097 | SPC10197 | Collinsella_aerofaciens | Ruminococcus_obeum | ++++ |
| SPC00009 | SPC10197 | Coprobacillus_sp_D7 | Ruminococcus_obeum | + |
| SPC00080 | SPC10197 | Coprococcus_catus | Ruminococcus_obeum | |
| SPC00018 | SPC10197 | Dorea_formicigenerans | Ruminococcus_obeum | ++++ |
| SPC00057 | SPC10197 | Dorea_longicatena | Ruminococcus_obeum | − |
| SPC00008 | SPC10197 | Enterococcus_faecalis | Ruminococcus_obeum | ++++ |
| SPC10001 | SPC10197 | Erysipelotrichaceae_bacterium | Ruminococcus_obeum | |
| SPC00001 | SPC10197 | Escherichia_coli | Ruminococcus_obeum | +++ |
| SPC10110 | SPC10197 | Escherichia_coli | Ruminococcus_obeum | ++++ |
| SPC00022 | SPC10197 | Eubacterium_eligens | Ruminococcus_obeum | + |
| SPC00054 | SPC10197 | Faecalibacterium_prausnitzii | Ruminococcus_obeum | |
| SPC00056 | SPC10197 | Odoribacter_splanchnicus | Ruminococcus_obeum | − |
| SPC10048 | SPC10197 | Parabacteroides_merdae | Ruminococcus_obeum | |
| SPC00061 | SPC10197 | Roseburia_intestinalis | Ruminococcus_obeum | |
| SPC10197 | SPC10197 | Ruminococcus_obeum | Ruminococcus_obeum | ++++ |
| SPC00015 | SPC10197 | Streptococcus_thermophilus | Ruminococcus_obeum | +++ |
| SPC10211 | SPC10233 | Bacteroides_caccae | Ruminococcus_torques | ++++ |
| SPC10213 | SPC10233 | Bacteroides_eggerthii | Ruminococcus_torques | ++++ |
| SPC10030 | SPC10233 | Bacteroides_ovatus | Ruminococcus_torques | ++++ |
| SPC00006 | SPC10233 | Bacteroides_sp_1_1_6 | Ruminococcus_torques | ++++ |
| SPC00007 | SPC10233 | Bacteroides_sp_3_1_23 | Ruminococcus_torques | ++++ |
| SPC10019 | SPC10233 | Bacteroides_sp_D20 | Ruminococcus_torques | ++ |
| SPC00005 | SPC10233 | Bacteroides_vulgatus | Ruminococcus_torques | ++++ |
| SPC10081 | SPC10233 | Bacteroides_vulgatus | Ruminococcus_torques | ++++ |
| SPC00021 | SPC10233 | Blautia_producta | Ruminococcus_torques | ++++ |
| SPC00026 | SPC10233 | Clostridium_nexile | Ruminococcus_torques | + |
| SPC00027 | SPC10233 | Clostridium_sp_HGF2 | Ruminococcus_torques | |
| SPC10097 | SPC10233 | Collinsella_aerofaciens | Ruminococcus_torques | ++++ |
| SPC00009 | SPC10233 | Coprobacillus_sp_D7 | Ruminococcus_torques | ++++ |
| SPC00080 | SPC10233 | Coprococcus_catus | Ruminococcus_torques | + |
| SPC00018 | SPC10233 | Dorea_formicigenerans | Ruminococcus_torques | ++++ |
| SPC00057 | SPC10233 | Dorea_longicatena | Ruminococcus_torques | |
| SPC00008 | SPC10233 | Enterococcus_faecalis | Ruminococcus_torques | ++++ |
| SPC10001 | SPC10233 | Erysipelotrichaceae_bacterium | Ruminococcus_torques | + |
| SPC00001 | SPC10233 | Escherichia_coli | Ruminococcus_torques | ++++ |
| SPC10110 | SPC10233 | Escherichia_coli | Ruminococcus_torques | ++++ |
| SPC00022 | SPC10233 | Eubacterium_eligens | Ruminococcus_torques | ++ |
| SPC00054 | SPC10233 | Faecalibacterium_prausnitzii | Ruminococcus_torques | |
| SPC00056 | SPC10233 | Odoribacter_splanchnicus | Ruminococcus_torques | |
| SPC10048 | SPC10233 | Parabacteroides_merdae | Ruminococcus_torques | + |
| SPC00061 | SPC10233 | Roseburia_intestinalis | Ruminococcus_torques | + |
| SPC10197 | SPC10233 | Ruminococcus_obeum | Ruminococcus_torques | ++++ |

TABLE 9-continued

| SPC1 | SPC2 | OTU1 | OTU2 | Result |
|---|---|---|---|---|
| SPC10233 | SPC10233 | Ruminococcus_torques | Ruminococcus_torques | ++++ |
| SPC00015 | SPC10233 | Streptococcus_thermophilus | Ruminococcus_torques | + |
| SPC00006 | SPC00015 | Bacteroides_sp_1_1_6 | Streptococcus_thermophilus | +++ |
| SPC00007 | SPC00015 | Bacteroides_sp_3_1_23 | Streptococcus_thermophilus | +++ |
| SPC00005 | SPC00015 | Bacteroides_vulgatus | Streptococcus_thermophilus | + |
| SPC00009 | SPC00015 | Coprobacillus_sp_D7 | Streptococcus_thermophilus | + |
| SPC00008 | SPC00015 | Enterococcus_faecalis | Streptococcus_thermophilus | ++++ |
| SPC00001 | SPC00015 | Escherichia_coli | Streptococcus_thermophilus | + |
| SPC00015 | SPC00015 | Streptococcus_thermophilus | Streptococcus_thermophilus | |

SEQUENCE LISTING (2043 sequences)

SEQ ID NO: 1 - DNA, 1532 bp, Abiotrophia defectiva
atgagagtttgatcctggctcaggatgaacgctggcggcgtgcctaacacatgcaagtcgaacggagattacggacggaagttttcggatggaagcctgtaattcttagtggcggacgggtgagtaacgcgtgggcaacctgccctatacagggggatagcagctggaaacggctggtaagaccgcataagtcggttaaatcgcatgatttgatcgggaaatgagcaatcaggtataggatgggcccgcgtccgattagccagttggcagggtaaaagcctaccaaagcgacgatcggtagccggactgagaggtcggacggccacattgggactgagacacggcccaaactcctacgggaggcagcagtgggggatattgcacaatggaggaaactctgatgcagcgacgccgcgtgagtgaagaagtatttcggtatgtaaagctctatcagcagggaagatgatgacggtacctgactaagaagccccggctaactacgcgccagcagccgcggtaatacgtagggggcaagcgttatccggatttactgggtgtaaagggagcgcaggcggttttgcaagttgagagtggaagcagggggctcaaccccctgactgctcccaaaactgtaaaacttgagtatgggagaggcaggcggaattcctagtgtagcggtgaaatgcttagatattaggaagaacaccggtggcgaaggcggcctgctggaccaaaactgacgctgaggctcgaaagcgtgggtagcaaacaggattagataccctggtagtccacgctgtaaacgatgaatactaggtgctgggatgcataagcatttcggtgccgtcgcaaacgcattaagtattccacctggggagtacgttcgcaagaatgaaactcaaaggaattgacggggacccgcacaagcggtggagcatgtggtttaattcgacgcaacgcgaagaaccttacccggtcttgagatcctcctgaatactgagtaatgtcagtagtccttcgggacaggagagacaggtggtgcatggttgtcgtcagctcgtgtcgtgagatgttgggttaagtcccgcaacgagcgcaacccctatttttagtagccagcggttcggccgggcactctaaagagactgccgaggataactcggaggaaggcggggatgacgtcaaatcatcatgccccttatgaccggggctacacacgtgctacaatggcagttacagagggaagcgaaggcgtgagccggagcaaatctcagaaaggctgcctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcagtggcctaaccgtaagggaggagctgccgaaggcaggtctggtgactggggtgaagtcgtaacaaggtagccgtatcggaaggtgcggctggatcacctcctttct

SEQ ID NO: 2 - DNA, 1407 bp, Abiotrophia para-adiacens
agagtttgatcatggctcaggacgaacgctggcggcgtgcctaatacatgcaagtcgaacgagagcgaccggtgcttgcactggtcaatctagtggcgaacgggtgagtaacacgtgggtaacctgcccatcagagggggataacattcggaaacggatgctaaaaccgcataggtcttcgaaccgcatggtttgaagaggaaaagaggcgcaagcttctgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggttttcggatcgtaaaactctgttgttagagaagaacaagtgctagagtaactgttagcgccttgacggtatctaaccagaaagccacggctaactacgtgccagcagccgcggtaatacgtaggtggcaagcgttgtccggatttattgggcgtaaagcgagcgcaggcggttccttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattgagttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcagttcggattgtaggctgcaactcgcctacatgaagccggaatcgctagtaatcgcggatcagcacgccgcggtgaatacgttcccgggtcttgtacacaccgcccgt

SEQ ID NO: 3 - DNA, 1328 bp, Abiotrophia sp.
  oral clone P4PA_155 P1
gacgaacgctggcggtgtgcctaatacatgcaagtcgaacgagtggcgaacgggtgagtaacacgtgggtaacctacctcatagtgggggataacagtcggaaacgactgctaataccgcatagggaaagtcgctaagagatggacccgcggtgcattagctggttggtagggtaaaggcctaccaaggcgatgatgcatagccgacctgagagggtgatcggccacattgggactgagactcggcccagactcctacgggaggcagcagtagggaatcttccgcaatggacgcaagtctgacggagcaacgccgcgtgagtgaagaaggtcttcggatcgtaaagctctgttgttggagaagatgacggtatctaaccggaaagccacggctaactacgtgccagcagccgcggtaatacgtaggtggcgagcgttgtccggatttattgggcgtaaagggagtgtaggcggtcttttaagtctgatgtgaaagcccacggctcaaccgtggagggtcattggaaactgggagacttgagtgcagaagaggagagcggaattccatgtgtagcggtgaaatgcgtagatatatggaggaacaccagtggcgaaggcggctctctggtctgactgacgctgaggctcgaaagcgtggggagcaaacaggattagataccctggtagtccacgccgtaaacgatgagtgctaagtgttggagcttcagtgctggagttaacgcaataagcactccgcctggggagtacggccgcaaggctgaaactcaaaggaattgacggggacccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctataactagttgccagcatggggactctagttagactgccggtgacaaaccggaggaaggtggggatgacgtcaaatcatcatgccccttatgacctgggctacacacgtgctacaatggatggcaacgagcagcgaactcgcgagggtaagcgaatctctaccattctcagttcggatgtagtctgcaacccgactacagaagccggaatcgctagtaatcgcggatcagcacgccgcggtgaatacgttcccgggtcttgtacacaccgcccgtcacaccacgagagtttgtaacacccgaagccggtgcctagggagccgtcgaaggtgggatagatgattggggtgaagtcgtaacaaggtagccgtatcggaaggtgc

SEQ ID NO: 4 - DNA, 1533 bp, Acetanaerobacterium elongatum
gagtttgatcctggctcaggacgaacgctggcggcgcgcctaacacatgcaagtcgagcggagtaatgtctaacacagagcggtgaaggatgattcactgttgtgtgttagatgttacttagcggcggacgggtgagtaacacgtgagcaatctgcctttcagagggggataacgtttggaaacgaacgctaataccgcatgatatacctaggtcgcatgaccttggtatcaaaggagcaatccgctgaaagatgagctcgcgtccgattaggtagttggtgaggtaacggcccaccaagcctgcgatcggtagccggactgagaggtcgatcggccacattgggactgagacacggcccagactcctacgggaggcagcagtgggggatattgcacaatggaggaaactctgatgcagcgacgccgcgtgagggaagaaggtcttcggattgtaaacctctgtcttcggggacgataatgacggtacccgaggaggaagccacggctaactacgtgccagcagccgcggtaatacgtaggtggcaagcgttgtccggaattactgggtgtaaagggagcgtaggcgggctcgcaagttgaatgttaaatctaccggctcaaccggtaaccgcgttcaaaactgcgagtcttgagtgtagtagaggcaggcggaattcctagtgtagcggtgaaatgcgtagatattaggaggaacaccagtggcgaaggcggcctgctgggcttttactgacgctgatgctcgaaagcatggggagcaaacaggattagataccctggtagtccatgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcgcacgcattacctagagatagggaagcccttcggggcgtgtagacaggtggtgcatggttgtcgtcagctcgtgtcgtgagatgttgggttaagtcccgcaacgagcgcaacccttacagttagttgctacgcaagagcactctaacaggactgccgttgacaaaacggaggaaggtggggatgacgtcaaatcatcatgccccttatgacctgggccacacacgtactacaatggccatcaacagaggggtgcaaagccgcgaggcagagcaaatctcaaaaaatggtctcagttcggattgcaggctgcaactcgcctgcatgaagccggaattgctagtaatcgcgaatcagcatgtcgcggtgaatacgttcccgggccttgtacacaccgcccgtcacaccatgagagccggtaacacccgaagcttgtagtctaaccgcaaggaggacgcaattgaaggtggggctggtaattggggtgaagtcgtaacaaggtagccgtatcggaaggtgcggctggatcacctcctta

SEQ ID NO: 5 - DNA, 1464 bp, Acetivibrio cellulolyticus
gacgaacgctggcggcgtgcttaacacatgcaagtcgagcggagaatatagcaatatattcttagcggcggacgggtgagtaacgcgtgggcaatctgcctcatacagggggataacactgggaaactagtgctaataccgcataaaatagtgaagtggcatcactttactatcaaaggagcaatccggtgtgagatgagcccgcgtccgattagctagttggtggggtaacggcccaccaaggcgacgatcggtagccgaactgagaggttgatcggccacattgggactgagacacggcccagactcctacgggaggcagcagtggggaatattgcgcaatgggggaaaccctgacgcagcaacgccgcgtgaaggatgaaggttttcggattgtaaacttctttgattggggacgataatgacggtacccaaaaaacaagccacggctaactacgtgccagcagccgcggtaatacgtaggtggcaagcgttgtccggatttactgggtgtaaagggcgtgtaggcggggatgcaagtcagatgtgaaattcggggctcaaccccggcgctgcatctgaaactgtatctcttgagtgctggagaggaaagcggaattcctagtgtagcggtgaaatgcgtagatattaggaggaacaccagtggcgaaggcggctttctggacagtaactgacgctgaggcgcgaaagcgtggggagcgaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacataccattgacgtayctagagataggtatttcttcgggacaatggatacaggtggtgcatggttgtcgtcagctcgtgtcgtgagatgttgggttaagtcccgcaacgagcgcaacccctgttgttagttgccatcattaagttgggcactctagcgagactgccggtgacaaatcggaggaaggtggggacgacgtcaaatcatcatgccccttatgtcctgggctacacacgtactacaatggctattacagagggaagcgaagccgtgaggtggagcaaatctccaaaaatagtcccagttcagattgtaggctgaaactcgcctacatgaagtcggaattgctagtaatggcaggtcagcatactgccgtgaatacgttcccgggccttgtacacaccgcccgtcacaccatgagagtctgcaacacccgaagtcagtagtctaactgtaaagaggacgctgccgaaggtggggccgatgattggggtgaagtcgtaacaaggtagccgtatcggaaggtgc

SEQ ID NO: 6 - DNA, 1529 bp, Acetivibrio ethanolgignens
tgatcctggctcaggatgaacgctggcggcgtgcttaacacatgcaagtcgaacgaagcacttaaaacagattggaatagcttgctaggaagagaagttttatttgactgagtggcggacgggtgagtaacgcgtgggtaacctgcctcacacagggggataacagttagaaatgactgctaataccgcataatatgcagcctcgcatgagactgctttgaaaactccggtggtgtgagatgggcccgcgtctgattagccagttggcagggtaacggcctaccaaagcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtaggtggttcggcaagtctgatgtgaaagcccggggctcaaccccgggactgcattggaaactgtcggacttgagtgctggagaggtaagtggaattcctagtgtagcggtgaaatgcgtagatattaggaggaacaccagtggcgaaggcggcttactggacagtaactgacactgaggctcgaaagcgtggggagcaaacaggattagataccctggtagtccacgccgtaaacgatgaatactaggtgtcggggcccataagggcttcggtgccgcagctaacgcaataagtattccacctggggagtacgttcgcaagaatgaaactcaaaggaattgacggggacccgcacaagcggtggagcatgtggtttaattcgaagcaacgcgaagaaccttaccaggtcttgacatcccgacgaccggcccgtaacggggtcctttcttcggaacgtcggtgacaggtggtgcatggttgtcgtcagctcgtgtcgtgagatgttgggttaagtcccgcaacgagcgcaacccctgttcttagtagccagcagttcggctgggcactctagggagactgccagggataacctggaggaaggtggggatgacgtcaaatcatcatgccccttatgatctgggctacacacgtgctacaatggcgtaaacaaagggaagcgaccctgtgaaggtaagcaaatctcaaaaataacgtctcagttcggattgtagtctgcaactcgactacatgaagctggaatcgctagtaatcgcaaatcagaatgttgcggtgaatacgttcccgggtcttgtacacaccgcccgtcacaccatgggagtcggatatgcccgaagtcagtgacctaaccgcaaggagggagctgccgaaggtggagccgatgactggggtgaagtcgtaacaaggtagccgtatcggaaggtgcggctggatcacctcctt

SEQ ID NO: 7 - DNA, 1480 bp, Acetobacter aceti
gagtttgattctggctcagagcgaacgctggcggcatgcttaacacatgcaagtcgcacgaaggcttcggccttagtggcggacgggtgagtaacgcgtaggaatctatccatgggtgggggataactccgggaaactggagctaataccgcatgatacctgagggtcaaaggcgcaagtcgcctgtggaggagtctgcgtttgattagcttgttggtggggtaaaggcctaccaaggcgatgatcaatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtatgagagagggttgtggaattctcagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctggatgttgggtaacttagttactcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatggagaggctgtattcagagatggatatttcccgcaagggacctcttgcacaggtgctgcatggctgtcgtcagctcgtgtcgtgagatgttgggttaagtcccgcaacgagcgcaacccttatctttagttgccagcatgtttgggtgggcactctaaagagactgccggtgacaagccggaggaaggtggggatgacgtcaagtcctcatggcccttatgtcctgggctacacacgtgctacaatggcggtgacagtgggaagctagatggcgacatcgtgccgatctctaaaaaccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctccttt

SEQ ID NO: 8 - DNA, 1442 bp, Acetobacter fabarum
agcgaacgctggcggcatgcttaacacatgcaagtcgcacgaacctttcggggttagtggcggacgggtgagtaacgcgtaggaatctgtccacgggtgggggataactctgggaaactggagctaataccgcatgatacctgagggtcaaaggcgcaagtcgcctgtggaggagcctgcgttcgattagctagttggtggggtaaaggcctaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttacacagtcagatgtgaaatccccgggcttaacctgggagctgcatttgatacgtgtagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtaactttgttattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgtattcagagatggatatttcccgcaagggacctctaacacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggtgacatcgtgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacc

SEQ ID NO: 9 - DNA, 1443 bp, Acetobacter lovaniensis
tgagttttgatcctggctcagagcgaacgctggcggcatgcttaacacatgcaagtcgcacgaacctttcggggttagtggcggacgggtgagtaacgcgtaggaatctgtccacgggtgggggataactctgggaaactggagctaataccgcatgatacctgagggtcaaaggcgcaagtcgcctgtggaggagcctgcgttcgattagctagttggtggggtaaaggcctaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttacacagtcagatgtgaaatccccgggcttaacctgggagctgcatttgatacgtgtagactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctagatgttgggtaactttgttattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgtattcagagatggatatttcccgcaagggacctctaacacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggtgacatcatgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtccagcgactggggtgaagtcgtac

SEQ ID NO: 10 - DNA, 1442 bp, Acetobacter malorum
agcgaacgctggcggcatgcttaacacatgcaagtcgcacgaaggcttcggccttagtggcggacgggtgagtaacgcgtaggaatctatccacgggtgggggataactccgggaaactggagctaataccgcatgatacctgagggtcaaaggcgcaagtcgcctgtggaggagcctgcgtttgattagcttgttggtggggtaatggcctaccaaggcgatgatcaatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagttagatgtgaaatccccgggcttaacctgggagctgcatttaatacgtgcagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctggatgttgggtaacttagttactcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatgggtaggctgtgtccagagatgggcatttcccgcaagggacctaccgcacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcgatgacaatgggaagctagatggcgacatcgtgctgatctcaaaaagtcgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacc

SEQ ID NO: 11 - DNA, 1401 bp, Acetobacter orientalis
tgagtttgatcctggctcagagcgaacgctggcggcatgcttaacacatgcaagtcgcacgaaggtttcggccttagtggcggacgggtgagtaacgcgtaggaatctatccatgggtgggggataactctgggaaactggagctaataccgcatgatacctgagggtcaaaggcgcgagtcgcctgtggaggagcctgcgtttgattagcttgttggtggggtaatggcctaccaaggcgatgatcaatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcataactgacgctgaggcgcgaaagcgtggggagcaaacaggattagataccctggtagtccacgctgtaaacgatgtgtgctagatgttgggtaacttagttattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgtatgggtaggctgtgtccagagatgggcatttcccgcaagggacctaccgcacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggcgacatcgtgctgatctctaaaaaccgtctcagttcggattgtactctgcaactcgagtacatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgca

SEQ ID NO: 12 - DNA, 1479 bp, Acetobacter pasteurianus
gagtttgattctggctcagagcgaacgctggcggcatgcttaacacatgcaagtcgcacgaaggtttcggccttagtggcggacgggtgagtaacgcgtaggtatctatccatgggtgggggataacactgggaaactggtgctaataccgcatgacacctgagggtcaaaggcgcaagtcgcctgtggaggagcctgcgtttgattagctagttggtggggtaaaggcctaccaaggcgatgatcaatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtgacttagtcattcagtgtcgcacttaacgcgttaagcacaccgcctggggagtacggccgcaaggttgaaactcaaaggaattgacgggggcccgcacaaggcgtggagcatgtggtttaattcgaagcaacgcgcagaaccttaccagggcttgaatgtagaggctgcaagcagagatgtttgtttcccgcaagggacctctaacacaggtgctgcatggctgtcgtcagctcgtgtcgtgagatgttgggttaagtcccgcaacgagcgcaacccctatctttagttgccatcaggttgggctgggcactctagagagactgccggtgacaagccggaggaaggtggggatgacgtcaagtcctcatggcccttatgtcctgggctacacacgtgctacaatggcggtgagagtgggaagctaggtggtgacaccatggtgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagcgaccacggtcgggtcagcgactggggtgaagtcgtaacaaggtagccgtaggggaacctgcggctggatcacctccttt

SEQ ID NO: 13 - DNA, 1440 bp, Acetobacter pomorum
agcgaacgctggcggcatgcttaacacatgcaagtcgcacgaaggtttcggccttagtggcggacgggtgagtaacgcgtaggtatctatccatgggtgggggataacactgggaaactggtgctaataccgcatgacacctgagggtcaaaggcgcaagtcgcctgtggaggagcctgcgtttgattagctagttggtggggtaaaggcctaccaaggcgatgatcaatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtatgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtaacttagttattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgcaagcagagatgtttgtttcccgcaagggacctctaacacaggtgctgcatggctgtcgtcagctcgtgtcgtgagatgttgggttaagtcccgcaacgagcgcaacccctatctttagttgccatcaggttgggctgggcactctagagagactgccggtgacaagccggaggaaggtggggatgacgtcaagtcctcatggcccttatgtcctgggctacacacgtgctacaatggcggtgacagtgggaagctaggtggtgacaccatgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacc

SEQ ID NO: 14 - DNA, 1412 bp, Acetobacter syzygii
agcgaacgctggcggcatgcttaacacatgcaagtcgcacgaacctttcggggttagtggcggacgggtgagtaacgcgtaggaatctgtccatgggtgggggataactctgggaaactggagctaataccgcatgatacctgagggtcaaaggcgcaagtcgcctgtggaggagcctgcgttcgattagctagttggtggggtaaaggcctaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtacagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtgactttgtcattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgtattcagagatggatatttcccgcaagggacctctaacacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggtgacatcgtgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtg

SEQ ID NO: 15 - DNA, 1443 bp, Acetobacter tropicalis
  modified_base (9)..(9): a, c, t, g, unknown or other
tgagttganctggctcagagcgaacgctggcggcatgcttaacacatgcaagtcgcacgaaggtttcggccttagtggcggacgggtgagtaacgcgtaggaatctatccatgggtgggggataactctgggaaactggagctaataccgcatgatacctgagggtcaaaggcgcaagtcgcctgtggaggagcctgcgttcgattagcttgttggtggggtaatggcctaccaaggcgatgatcgatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggcaacttagttgttcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatgtgtaggctgtgtccagagatgggcatttcccgcaagggacctacagcacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggcgacatcgtgctgatctctaaaagccgtctcagttcggattgcactctgcaactcgagtgcatgaaggtggaatcgctagtaatcgcggatcaagcatgccgcggtgaatacgttcccgggccttgtacacaccgcccgtcacaccatgggagttggtttgaccttaagccggtgagcgaacccagctaatggggcgcagccgaccacggtcgggtcagcgactggggtgaagtcgtac

SEQ ID NO: 16 - DNA, 1475 bp, Acetobacteraceae bacterium AT-5844
agagtttgatcctggctcagagtgaacgctggcggcatgcttaacacatgcaagtcgtgcgccccgcaaggggagcggcggacgggtgagtaacacgtaggaatgtgtccggaggtgggggataaccctgggaaactagggctaataccgcatatgggctgaggcccaaagccgtgaggcgccatcggagtagcctgcgcctgattagctagttggtggggtaaaggcctaccaaggcgacgatcagtagctggtctgagaggacgatcagccacactgggactgagacacggcccagactcctacgggaggcagcagtggggaatattggacaatgggcgcaagcctgatccagcaatgccgcgtgtgtgaagaaggtcttcggatcgtaaagcactttcggcggggacgatgatgacggtacccgcagaagaagccccggctaacttcgtgccagcagccgcggtaatacgaagggggctagcgttactcggaattactgggcgtaaagggcgcgtaggcggcgttccaagttaggcgtgaaagtcctgggctcaacctgggaactgcgcttaagactggagtgcttgaggatggaagagggttgtggaattcccagtgtagaggtgaaattcgtagatattgggaagaacaccggtggcgaaggcggcaacctggtccattactgacgctgaggcgcgatagcgtggggagcaaacaggattagataccctggtagtccacgccgtaaacgatgtgcgctggatgttgggggtcctagaccttcagtgtcgtagctaacgcgataagcgcaccgcctggggagtacggccgcaaggttgaaactcaaaggaattgacgggggcccgcacaagcggtggagcatgtggtttaattcgaagcaacgcgcagaaccttaccagctcttgacatgggtaggaccggtgcagagatgcacttttcccgcaagggacctaccgcacaggtgctgcatggctgtcgtcagctcgtgtcgtgagatgttgggttaagtcccgcaacgagcgcaaccctcgcctttagttgccagcatgtttgggtgggcactctaaaggaactgccggtgacaagccggaggaaggtggggatgacgtcaagtcctcatggcccttatgggctgggctacacacgtgctacaatggcggtgacaacgggatgccaggcagcgatgccgagccgatcccaaaaagccgtctcagttcagattgcagcctgcaactcggctgcatgaaggtggaatcgctagtaatcgcggatcagcacgccgcggtgaatacgttcccgggccttgtacacaccgcccgtcacaccatgggagttggttttaccttaagtcggtgcggtaaccgcaaggagctagccgaccacggtaggatcagtgactggggtgaagtcgtaacaaggtagccgtaggggaacctgcggctggatcacct

SEQ ID NO: 17 - DNA, 1506 bp, Acholeplasma laidlawii
tatatggagagtttgatcctggctcaggatgaacgctggcggcgtgcctaatacatgcaagtcgaacgaagcatcttcggatgcttagtggcgaacgggtgagtaacacgtagataacctacctttaactcgaggataactccgggaaactggagctaatactggataggatgtgtgcatgaaaaaaacacatttaaagatttatcggtttaagaggggtctgcggcgcattagttagttggtggggtaaaagcctaccaagacgatgatgcgtagccggactgagaggtctaccggccacattgggactgagaacggcccaaactcctacgggaggcagcagtagggaattttcggcaatgggggaaaccctgaccgagcaacgccgcgtgaacgacgaagtacttcggtatgtaaagttcttttatatgggaagaaaaattaaaaattgacggtaccatatgaataagccccggctaactatgtgccagcagccgcggtaatacatagggggcgagcgttatccggatttactgggcgtaaagggtgcgtaggtggttataaaagtttgtggtgtaagtgcagtgcttaacgctgtgaggctatgaaaactatataactagagtgagacagaggcaagtggaattccatgtgtagcggtaaaatgcgtaaatatatggaggaacaccagtggcgaaggcggcttgctgggtctatactgacactgatgcacgaaagcgtggggagcaaacaggattagataccctggtagtccacgccgtaaacgatgagaactaagtgttggccaaaaggtcagtgctgcagttaacgcattaagttctccgcctgagtagtacgtacgcaagtatgaaactcaaaggaattgacgggaccccgcacaagcggtggatcatgttgtttaattcgaagatacacgaaaaaccttaccaggtcttgacatactctgcaaaggcttagaaataagttcggaggctaacagatgtacaggtggtgcacggttgtcgtcagctcgtgtcgtgagatgttgggttaagtcccgcaacgagcgcaacccttattgctagttaccatcattaagttggggactctagcgagactgccagtgataaattggaggaaggtggggatgacgtcaaatcatcatgccccttatgacctgggctacaaacgtgatacaatggctggaacaaagagaagcgatagggtgacctggagcgaaactcacaaaaacagtctcagttcggattggagtctgcaactcgactccatgaagtcggaatcgctagtaatcgcaaatcagcatgttgcggtgaatacgttctcggggtttgtacacaccgcccgtcaaaccacgaaagtgggcaatacccaacgccggtggcctaacccgaaagggagggagccgtctaaggtagggtccatgattggggttaagtcgtaacaaggtatccctacgggaacgtggggatggatcacctcctttct

SEQ ID NO: 18 - DNA, 1523 bp, Achromobacter denitrificans
  modified_base (847)..(847): a, c, t, g, unknown or other
  modified_base (1509)..(1509): a, c, t, g, unknown or other
agagtttgatcatggctcagattgaacgctagcgggatgccttacacatgcaagtcgaacggcagcacggacttcggtctggtggcgagtggcgaacgggtgagtaatgtatcggaacgtgcccagtagcgggggataactacgcgaaggcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgcgggttaataccccggggaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcanctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcctgaagagatttaggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggagggcgattaccacggtaggattcatgactggggtgaagtcgtaacaaggtagccgtatcggaaggtgcggntggatcacctcctt

SEQ ID NO: 19 - DNA, 1534 bp, Achromobacter piechaudii
ttaaactgaagagtttgatcctggctcagattgaacgctagcgggatgccttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgtaagaccttgcactattagagcggccgatatcggattagctagttggtggggtaatggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaactggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 20 - DNA, 1534 bp, Achromobacter xylosoxidans
ttaaactgaagagtttgatcctggctcagattgaacgctagcgggatgccttacacatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgcgggttaatacctcgcgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagagccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 21 - DNA, 1545 bp, Acidaminococcus fermentans
agagtttgatcctggctcaggacgaacgctggcggcgtgcttaacacatgcaagtcgaacggagaactttcttcggaatgttcttagtggcgaacgggtgagtaacgcgtaggcaacctgccctctggttggggacaacattccgaaagggatgctaataccgaatgagatcctctttccgcatggagagaggatgaaagatggcctctacttgtaagctatcgccagaagatgggcctgcgtctgattagcttgtaggtgaggtaacggctcacctaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggccttcgggttgtaaaactctgttgtcagggacgaaagcaccgatctataatacattttggtgttgacggtacctgacgaggaagccacggctaactacgtgccagcagccgcggtaatacgtaggtggcaagcgttgtccggaattattgggcgtaaagagcatgtaggcgggcttttaagtccgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatgggtactaggtgtaggaggtatcgaccccttctgtgccggagttaacgcaataagtaccccgcctggggactacgatcgcaagattgaaactcaaaggaattgacgggggcccgcacaagcggtggagtatgtggtttaattcgacgcaacgcgaagaaccttaccaaggcttgacattgagtgaaagacccagagatgggtccccttcttcggaagcacgaaaacaggtggtgcatggctgtcgtcagctcgtgtcgtgagatgttgggttaagtcccgcaacgagcgcaacccttatcctatgttaccagcacgtaatggtggggactcataggagactgccagggataacctggaggaaggcggggatgacgtcaagtcatcatgccccttatgtcttgggctacacacgtactacaatggtcggcaacaaagggcagcgaagccgcgaggcggagccaatcccagaaacccgaccccagttcggatcgcaggctgcaacccgcctgcgtgaagttggaatcgctagtaatcgcaggtcagcatactgcggtgaatacgttcccgggccttgtacacaccgcccgtcacaccacgaaagttggtaacacccgaagccggtgagataaccttttaggagtcagctgtctaaggtggggccgatgattggggtgaagtcgtaacaaggtagccgttcgagaacgagcggctggatcacct

SEQ ID NO: 22 - DNA, 1489 bp, Acidaminococcus intestini
ctggcggcgtgcttaacacatgcaagtcgaacggagaacttatttcggtaagttcttagtggcgaacgggtgagtaacgcgtgggcaacctgccctccagttggggacaacattccgaaagggatgctaataccgaatgtcctccctcctccgcatggaggagggaggaaagatggcctctgcttgcaagctatcgctggaagatgggcccgcgtctgattagctagttggtggggtaacggctcaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaaactctgttgttagggacgaaagcaccgtgttcgaacaggtcatggtgttgacggtacctaacgaggaagccacggctaactacgtgccagcagccgcggtaatacgtaggtggcaagcgttgtccggaattattgggcgtaaagagcatgtaggcgggcttttaagtctgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatggatactaggtgtaggaggtatcgaccccttctgtgccggagttaacgcaataagtatcccgcctggggactacgatcgcaagattgaaactcaaaggaattgacgggggcccgcacaagcggtggagtatgtggtttaattcgacgcaacgcgaagaaccttaccaaggcttgacattgagtgaaagacctagagataggtccctcccttcggggacacgaaaacaggtggtgcatggctgtcgtcagctcgtgtcgtgagatgttgggttaagtcccgcaacgagcgcaacccctatcctatgttaccagcgcgtaaaggcggggactcataggagactgccagggataacttggaggaaggcggggatgacgtcaagtcatcatgccccttatgtcttgggctacacacgtactacaatggtcggcaacaaagggcagcgaaaccgcgaggtggagcaaatcccagaaacccgaccccagttcggatcgtaggctgcaacccgcctacgtgaagttggaatcgctagtaatcgcaggtcagcatactgcggtgaatacgttcccgggccttgtacacaccgcccgtcacaccacgaaagttggtaacacccgaagccggtgagataaccttttaggagtcagctgtctaaggtggggccgatgattggggtgaagtcgtaacaaggtagc

SEQ ID NO: 23 - DNA, 1556 bp, Acidaminococcus sp.
  D21
ttggagagtttgatcctggctcaggacgaacgctggcggcgtgcttaacacatgcaagtcgaacggagaacttatttcggtaagttcttagtggcgaacgggtgagtaacgcgtgggcaacctgccctccagttggggacaacattccgaaagggatgctaataccgaatgtcctccctcctccgcatggaggagggaggaaagatggcctctgcttgcaagctatcgctggaagatgggcccgcgtctgattagctagttggtggggtaacggctcaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaaactctgttgttagggacgaaagcaccgtgttcgaacaggtcatggtgttgacggtacctaacgaggaagccacggctaactacgtgccagcagccgcggtaatacgtaggtggcaagcgttgtccggaattattgggcgtaaagagcatgtaggcgggcttttaagtctgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatggatactaggtgtaggaggtatcgaccccttctgtgccggagttaacgcaataagtatcccgcctggggactacgatcgcaagattgaaactcaaaggaattgacgggggcccgcacaagcggtggagtatgtggtttaattcgacgcaacgcgaagaaccttaccaaggcttgacattgagtgaaagacctagagataggtccctcccttcggggacacgaaaacaggtggtgcatggctgtcgtcagctcgtgtcgtgagatgttgggttaagtcccgcaacgagcgcaacccctatcctatgttaccagcgcgtaaaggcggggactcataggagactgccagggataacttggaggaaggcggggatgacgtcaagtcatcatgccccttatgtcttgggctacacacgtactacaatggtcggcaacaaagggcagcgaaaccgcgaggtggagcaaatcccagaaacccgaccccagttcggatcgtaggctgcaacccgcctacgtgaagttggaatcgctagtaatcgcaggtcagcatactgcggtgaatacgttcccgggccttgtacacaccgcccgtcacaccacgaaagttggtaacacccgaagccggtgagataaccttttaggagtcagctgtctaaggtggggccgatgattggggtgaagtcgtaacaaggtagccgttcgagaacgagcggctggatcacctcctttct

SEQ ID NO: 24 - DNA, 1451 bp, Acidilobus saccharovorans
tccggttgatcctgccggacccgactgctatcggggtgaggctaagccatgggagtcgcgcgcccagccgccgctgggcgggcgcacggctgagtaacacgtagctaacctaccctcgggacggggataaccccgggaaactggggctaatccccgataggcgagggggcctggaatggtccctcgccgaaagggaccctggggggttatcgcctggggtccgcccgaggatggggctgcggcccatcatggtagttggcggggtaatggcccgccaagccgacgacgggtaggggccgtgggagcgggagcccccagatgggccctgagacaagggcccaggccctacggggcgcaccaggcgcgaaacctccgcaatgcgggaaaccgtgacggggtcaccccgagtgctcccgtaagggagcttttccccgctgcaaggaggcgggggaataagcggggggcaagtctggtgtcagccgccgcggtaataccagccccgcgagtggtcgggacgtctactgggcctaaagcgcccgtagccggccccgtaagtccctcctgaaagccctgggctcaacccagggagtgggggggatactgcggggctagggggcgggagaggccgggggtaccccaggggtaggggcgaaatccgataatccctgggggaccaccagtggcgaaagcgcccggctggaacgcgcccgacggtgaggggcgaaagccgggggagcgaaccggattagatacccgggtagtcccggctgtaaacgatgcgggctaggtgtcgggcgggcgttagagcccgcccggtgccgcagggaagccgttaagcccgccgcctggggagtacggccgcaaggctgaaactttaaggaattggcgggggggcacacaaggggtggagcctgcggctcaattggagtcaacgccgggaacctcaccgggggcgacagcaggatgacggccaggctaacgaccttgcccgacgcgctgaggggaggtgcatggccgtcgccagctcgtgctgtgaagtgtcctgttaagtcaggcaacgagcgagacccccgcccctagttgcgacccggcgggagaccgttggggcacactagggggactgccgccgctaaggcggaggaaggagggggccacggcaggtcagcatgcccctaaaccccgggttgcacgcgggctacaatggcgggracagcgggatccgaccccgaaagggggaggcaatccctcaaaccccgccgtagtcgggattgggggctgtaactcgcccccatgaacctggaatccctagtaaccgcgcgtcaacatcgcgcggtgaatacgtccctgccccttgtacacactgcccgtcgctccacctgagagaaggaggggtgaggcttcctccttcgggagggagtcgaacccctccttctcgaggggggagaagtcgt

SEQ ID NO: 25 - DNA, 1524 bp, Acidithiobacillus ferrivorans
agagtttgatcctggctcagattgaacgctggcggcatgcctaacacatgcaagtcgaacggtagcaggccttcgggtgctgacgagtggcggacgggtgagtaatgcgtaggaatctgtcttttagtgggggacaacccagggaaacttgggctaataccgcatgagccctgagggggaaagcgggggatcttcggacctcgcgctaagagaagagcctacgtctgattagctagttggtagggtaaaggcctaccaaggcgacgatcagtagctggtctgagaggacgaccagccacactgggactgagacacggcccagactcctacgggaggcagcagtggggaatttttcgcaatgggggcaaccctgacgaagcaatgccgcgtggatgaagaaggccttcgggttgtaaagtcctttcgtgggggacgaaaaggtggttcctaatacgagctgctgttgacgtgaacccaagaagaagcaccggctaactccgtgccagcagccgcggtaatacggggggtgcaagcgttaatcggaatcactgggcgtaaagggtgcgtaggcggtacgttaggtctgtcgtgaaatccccgggctcaacctgggaatggcggtagaaaccggcgaactagagtatgggagagggtggtggaattccaggtgtagcggtgaaatgcgtagagatctggaggaacatcagtggcgaaggcggccacctggcccaatactgacgctgaggcacgaaagcgtggggagcaaacaggattagataccctggtagtccacgccctaaacgatgaatactagatgtttggtacctagcgtactgagtgtcgtagctaacgcgataagtattccgcctgggaagtacggccgcaaggttaaaactcaaaggaattgacgggggcccgcacaagcggtggagcatgtggtttaattcgatgcaacgcgaagaaccttacctgggcttgacatgtccggaatcctgcagagatgcgggagtgcccttcggggaatcggaacacaggtgctgcatggctgtcgtcagctcgtgtcgtgagatgttgggttaagtcccgcaacgagcgcaacccttgtccttagttgccagcggttcggccgggcactctagggagactgccggtgacaaaccggaggaaggtggggatgacgtcaagtcctcatggcctttatgtccagggctacacacgtgctacaatggcgcgtacagagggacgccaaaccgcgaggtggagcagaccccagaaagcgcgtcgtagttcggattgcagtctgcaactcgactgcatgaagtcggaatcgctagtaatcgcggatcagcatgccgcggtgaatacgttcccgggccttgtacacaccgcccgtcacaccatgggagtagattgtaccagaagcggctagcctaaccttcgggagggcggttaccacggtatggtttatgactggggtgaagtcgtaacaaggtagccgtaggggaacctgcggctggatcacct

SEQ ID NO: 26 - DNA, 1332 bp, Acidovorax sp.
  98-63833
tgagtttgatcctggctcagattgaacgctggcggcatgccttacacatgcaagtcgaacgagtggcgaacgggtgagtaatacatcggaacgtgcctagtagtgggggataactactcgaaagagtggctaataccgcatgaggaaaggtgctactagagcggccgatggcagattaggtagttggtgggataaaagcttaccaagccaacgatctgtagctggtctgagaggacgatcagccacactgggactgagacacggcccagactcctacgggaggcagcagtggggaattttggacaatgggcgaaagcctgatccagcaatgccgcgtgcaggatgaaggccttcgggttgtaaactgcttttgtacggaacgatgacggtaccgtaagaataagcaccggctaactacgtgccagcagccgcggtaatacgtagggtgcaagcgttaatcggaattactgggcgtaaagcgtgcgcaggcggttttgtaagacagaggtgaaatccccgggctcaacctgggaactgcctttgtgactgcaaggctagagtacggcagagggggatggaattccgcgtgtagcagtgaaatgcgtagatatgcggaggaacaccgatggcgaaggcaatcccctgggcctactgacgctcatgcacgaaagcgtggggagcaaacaggattagataccctggtagtccacgccctaaacgatgtcaactggttgttgggtactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgcacaggtgctgcatggctgtcgtcagctcgtgtcgtgagatgttgggttaagtcccgcaacgagcgcaacccttgccattagttgctacggcactctaatgggactgccggtgacaaaccggaggaaggtggggatgacgtcaagtcctcatggcccttataggtggggctacacacgtcatacaatggctggcaaagggttgccaacccgcgagggggagctaatcccatccagtcgtagtccggacgcagtctgcaactcgactgcggaagtcggaatcgctagtaatcgtggatcagcatgtcacggtgaatacgttcccgggtcttgtacacaccgcccgtcacaccatgggagcgggtctcgccagaagtaggtgcctagggcgcttaccacggcggggttcgtgactggggtgaagtcgtaacaaggtagccgta

SEQ ID NO: 27 - DNA, 1539 bp, Acinetobacter baumannii
tttaactgaagagtttgatcatggctcagattgaacgctggcggcaggcttaacacatgcaagtcgagcgggggaaggtagcttgctaccggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctactttagttaatacctagagatagtggacgttactcgcagaataagcaccggctaactctgtgccagcagccgcggtaatacagagggtgcgagcgttaatcggatttactgggcgtaaagcgtgcgtaggcggcttattaagtcggatgtgaaatccccgagcttaacttgggaattgcattcgatactggtgagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctcctta

SEQ ID NO: 28 - DNA, 1607 bp, Acinetobacter calcoaceticus
cactactcacgcgttgggagctctcccatatggtcgacctgcaggcggccgcgaattcactagtgattagagtttgattatggctcagattgaacgctggcggcaggcttaacacatgcaagtcgagcggagtgatggtgcttgcactatcacttagcggcggacgggtgagtaatgcttaggaatctgcctattagtgggggacaacatttcgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgcaagcctgatccagccatgccgcgtgtgtgaagaaggccttatggttgtaaagcactttaagcgaggaggaggctactgaagttaataccttcagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcacgggccttgtacacaccgcccgtcacaccatgggagtttgttgcaccagaagtaggtagtctaaccgcaagggggacgcttaccacggtgtggccgatgactggggtgaagtcgtaacaaggtaaccgtaaatcgaattcccgcggccgccatggcggccggagctg

SEQ ID NO: 29 - DNA, 1296 bp, Acinetobacter sp.
  C1
attgaacgctggcggcaggcttaacacatgcaagtcgagcgagcggcggacgggtgagtaatgcttaggaatctgcctattagtgggggacaacattccgaaaggaatgctaataccgcatacggaaaggcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagtcatgccgcgtgtgtgaggaaggccttttggttgtaaagcactttaagcgaggaggaggacgttactcgcagaataagcaccggctaactctgtgccagcagccgcggtaatacagagggtgcgagcgttaatcggatttactgggcgtaaagcgtgcgtaggcggctgattaagtcggatgtgaaatccctgagcttaacttaggaattgcattcgatactggtcagctagagtatgggagaggatggtagaattccaggtgtagcggtgaaatgcgtagagatctggaggaataccgatggcgaaggcagccatctggcctaactgacgctgaggtacgaaagcatggggagcaaacaggattagataccctggtagtccatgccgtaaacgatgtctactagccgttggggctttagtggcgcggctaacgcgataagtagaccgcctggggagtacggtcgcaagactaaaactcaaatgaattgacgggggcccgcacaagcggtggagcatgtggtttaattcgatgcaacgcgaagaaccttacctggccttgacatatacaggtgctgcatggctgtcgtcagctcgtgccgtgagatgttgggttaagtcccgcaacgagcgcaacccttttccttacttgccagcatatgggaactttaaggatactgccagtgacaaactggaggaaggcggggacgacgtcaagtcatcatggcccttacggccagggctacacacgtgctacaatggtcggcaaagggttgctacctagcgataggatgctaatctcaaccgatcgtagtccggatggagtctgcaactcgactccagaagtcggaatcgctagtaatcgcggatcagaatgccgcggtgaatacgttcccgggccttgtacacaccgcccgtcacaccatgggagtttgttgcaccagaagtaggtgtctaggacgcttaccacggtgtggccgatgactggggtg

SEQ ID NO: 30 - DNA, 1540 bp, Acinetobacter haemolyticus
ttaaactgaagagtttgatcatggctcagattgaacgctggcggcaggcttaacacatgcaagtcgagcggggaagtgtagcttgctacattacctagcggcggacgggtgagtaatgcttaggaatctgcctattagtgggggacaacattccgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttttggttgtaaagcactttaagcgaggaggaggctactctagttaatacctagagatagtggacgttactcgcagaataagcaccggctaactctgtgccagcagccgcggtaatacagagggtgcgagcgttaatcggatttactgggcgtaaagcgtgcgtaggcggctgattaagtcggatgtgaaatccctgagcttaacttaggaattgcattcgatactggtcagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgatgactggggtgaagtcgtaacaaggtagccgtaggggaacctgcggctggatcacctcctta

SEQ ID NO: 31 - DNA, 1447 bp, Acinetobacter johnsonii
cctagcggcggacgggtgagtaatgcttaggaatctgcctattagtgggggacaacattccgaaaggaatgctaataccgcatacgccctacgggggaaagcaggggatcttcggaccttgcgctaatagatgagcctaagtcagattagctagttggtggggtaaaggcctaccaaggcgacgatctgtagcgggtctgagaggatgatccgccacactgggactgagacacggcccagactcctacgggaggcagcagtggggaatattggacaatgggcgaaagcctgatccagccatgccgcgtgtgtgaagaaggccttttggttgtaaagcactttaagcgaggaggaggctacttagattaatactctaggatagtggacgttactcgcagaataagcaccggctaactctgtgccagcagccgcggtaatacagagggtgcgagcgttaatcggatttactgggcgtaaagcgtgcgtaggcggcttcttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggaatttgttgcaccagaagtaggtagtctaaccgcaaggaggacgcttaccacggtgtggccgatgactggggtgaagtcgtaacaaggtagccgtaggggaacctgcggctggatcacctcctta

SEQ ID NO: 32 - DNA, 1537 bp, Acinetobacter junii
aactgaagagtttgatcatggctcagattgaacgctggcggcaggcttaacacatgcaagtcgagcggagatgaggtgcttgcaccttatcttagcggcggacgggtgagtaatgcttaggaatctgcctattagtgggggacaacattccgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaaccctgatccagccatgccgcgtgtgtgaagaaggccttatggttgtaaagcactttaagcgaggaggaggctactgagactaatactcttggatagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtagccgtaggggaacctgcggctggatcacctcctta

SEQ ID NO: 33 - DNA, 1449 bp, Acinetobacter lwoffii
gacctagcggcggacgggtgagtaatgcttaggaatctgcctattagtgggggacaacatctcgaaagggatgctaataccgcatacgtcctacgggagaaagcaggggaccttcgggccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctaccgagattaatactcttggatagtggacgttactcgcagaataagcaccggctaactctgtgccagcagccgcggtaatacagagggtgcaagcgttaatcggatttactgggcgtaaagcgcgcgtaggtggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacactgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccttaggggggacgcttaccacggtgtggcagatgactggggtgaagtcgtaacaaggtagccgtaggggaacctgcggctggatcacctcctta

SEQ ID NO: 34 - DNA, 1517 bp, Acinetobacter parvus
agagtttgatcatggctcagattgaacgctggcggcaggcttaacacatgcaagtcgagcggggattgggtgcttgcacctaatcttagcggcggacgggtgagtaatgcttaggaatctgccatttagtgggggacaacattccgaaagggatgctaataccgcatacgccctacgggggaaagcaggggatcttcggaccttgcgctaaatgatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttttggttgtaaagcactttaagcgaggaggaggctacctggattaatactctaggatagtggacgttactcgcagaataagcaccggctaactctgtgccagcagccgcggtaatacagagggtgcgagcgttaatcggatttactgggcgtaaagcgtgcgtaggcggctgattaagtcggatgtgaaatccctgagcttaacttaggaattgcattcgatactggtcagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtagaaactttccagagatggattggtgccttcgggaatctacatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccttaggggggacgcttaccacggtgtggccgatgactggggtgaagtcgtaacaaggtagccgtaggggaacctgcggctg

SEQ ID NO: 35 - DNA, 1539 bp, Acinetobacter radioresistens
tttaactgaagagtttgatcatggctcagattgaacgctggcggcaggcttaacacatgcaagtcgagcggatgaaggtagcttgctaccggattcagcggcggacgggtgagtaatgcttaggaatctgcctattagtgggggacaacgttccgaaaggagcgctaataccgcatacgtcctacgggagaaagcaggggacctttgggccttgcgctaatagatgagcctaagtcggattagctagttggtagggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctacctagattaatactttaggatagtggacgttactcgcagaataagcaccggctaactctgtgccagcagccgcggtaatacagagggtgcgagcgttaatcggatttactgggcgtaaagcgtgcgtaggcggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcccttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatacagagaactttccagagatggattggtgccttcgggaactctgatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtagccgtaggggaacctgcggctggatcacctcctta

SEQ ID NO: 36 - DNA, 1466 bp, Acinetobacter schindleri
ggcggcaggcttaacacatgcaagtcgagcggggaaaggtaccttgctacctgacctagcggcggacgggtgagtaatgcttaggaatctgcctattagtgggggacaacgttccgaaaggaacgctaataccgcatacgccctacgggggaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttttggttgtaaagcactttaagcgaggaggaggctcctttagttaatacctaaagagagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccctgagcttaacttaggaattgcattcgatactggaaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactaagaactttccagagatggattggtgccttcgggaacttagatacaggtgctgcatggctgtcgtcagctcgtgtcgtgagatgttgggttaagtcccgcaacgagcgcaacccttttccttatttgccatcgggtaatgccgggaactttaaggatactgccagtgacaaactggaggaaggcggggacgacgtcaagtcatcatggcccttacggccagggctacacacgtgctacaatggtcggtacaaagggttgctacctcgcgagaggatgctaatctcaaaaagccgatcgtagtccggatcgcagtctgcaactcgactgcgtgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactgggacgaagtcgtaacaaggta

SEQ ID NO: 37 - DNA, 1291 bp, Acinetobacter sp.
  56A1
gcttgctactggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtggaagaaggccttatggttgtaaagcactttaagcgaggaggaggctactttagttaatacctagagatagtggacgttactcgcagaataagcaccggctaactctgtgccagcagccgcggtaatacagagggtgcgagcgttaatcggatttactgggcgtaaagcgtgcgtaggcggcttattaagtcggatgtgaaatccccgagcttaacttgggaattgcattcgatactggtgagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtg

SEQ ID NO: 38 - DNA, 1513 bp, Acinetobacter sp.
  CIP 101934
ctcagattgaacgctggcggcaggcttaacacatgcaagtcgagcggggaaggttgcttcggtaactgacctagcggcggacgggtgagtaatgcttaggaatctgcctattagtgggggacaacgttccgaaaggaacgctaataccgcatacgccctacgggggaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgcaagcctgatccagccatgccgcgtgtgtgaagaaggccttttggttgtaaagcactttaagcgaggaggaggctcctttagttaatacctaaagtgagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccctgagcttaacttaggaattgcattcgatactggaaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactaagaactttccagagatggattggtgccttcgggaacttagatacaggtgctgcatggctgtcgtcagctcgtgtcgtgagatgttgggttaagtcccgcaacgagcgcaacccttttccttatttgccagcgggtaatgccgggaactttaaggatactgccagtgacaaactggaggaaggcggggacgacgtcaagtcatcatggcccttacggccagggctacacacgtgctacaatggtcggtacaaagggttgctacctcgcgagaggatgctaatctcaaaaagccgatcgtagtccggatcgcagtctgcaactcgactgcgtgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtagccgtaggggaacctgcggttggatcacctcc

SEQ ID NO: 39 - DNA, 1494 bp, Acinetobacter sp.
  CIP 102143
tggctcagattgaacgctggcggcaggcttaacacatgcaagtcgagcggggattgggtgcttgcacctaatcttagcggcggacgggtgagtaatgcttaggaatctgccatttagtgggggacaacattccgaaagggatgctaataccgcatacgccctacgggggaaagcaggggatcttcggaccttgcgctaaatgatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaagcctgatccagccatgccgcgtgtgtgaagaaggccttttggttgtaaagcactttaagcgaggaggaggctacctggattaatactctaggatagtggacgttactcgcagaataagcaccggctaactctgtgccagcagccgcggtaatacagagggtgcgagcgttaatcggatttactgggcgtaaagcgtgcgtaggcggctgattaagtcggatgtgaaatccctgagcttaacttaggaattgcattcgatactggtcagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtagaaactttccagagatggattggtgccttcgggaatctacatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccttaggggggacgcttaccacggtgtggccgatgactggggtgaagtcgtaacaaggtagccgtagggga

SEQ ID NO: 40 - DNA, 1465 bp, Acinetobacter sp.
  CIP 53.82
acatgcaagtcgagcggggatagggtgcttgcacctgattcctagcggcggacgggtgagtaaagcttaggaatctgcctattagtgggggacaacattccgaaagggatgctaataccgcatacgccctacgggggaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggcgctctaggataataccctagatgcgtggacgttactcgcagaataagcaccggctaactctgtgccagcagccgcggtaatacagagggtgcgagcgttaatcggatttactgggcgtaaagcgcgcgtaggtggctaattaagtcaaatgtgaaatccccgagcttaacttgggaattgcattcgatactggttagctagagtatgggagaggatggtagaattccaggtgtagcggtgaaatgcgtagagatctggaggaataccgatggcgaaggcagccatctggcctaatactgacactgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatacagagaactttccagagatggattggtgccttcgggaactctgatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccttagggaggacgcttaccacggtgtggccgatgactggggtgaagtcgtaacaaggtagccgtaggggaacc

SEQ ID NO: 41 - DNA, 1280 bp, Acinetobacter sp.
  M16-22
  modified_base (489)..(489): a, c, t, g, unknown or other
cgagcggacgggtgagtgatgcttgggagtctgcctgttagtgggggacaacttcttacaggggatgctaataccgcccacatcctaccggagaaagcaggggatcttccttccttgctctagtagatgaacctgcctcggattaactagttggtggggtaaaggcctacccaggcgaccatctatcccgggtctgagaggatgatccaccacactgggactgagacacagcccagactcctaccggaggcaggagtggggaatataggacaatggggggaaccctgatccatgcatgccgcgtgtgtgaagaaggccttatggttgtaaagcactttaatcgaggaggaggctactttagttagtacctagagatagtggacgttactcgcagaataagcaccggctaactctgtgccaccagccgcggtaatacagagggtgcgagcgttaatcggatttactgggcgtaaagcgcgcgcaggcggntatcaagtcggatgtgaaatccccgagctcaacttgggaattgcattcgatactggcgagctagagtatgggagaggagggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccggtggtgcctttgaggcgttagttgcgcagctaacgcgataagtagaccgcctggggagtacggtcgcaagattaaaactcaaatgaattgacgggggcccgcacaagcggtggagcatgtggtttaattcgatgcaacgcgaagaaccttacctggccttgacatactagaaactttccagagatggattggtgccttcgggaatttagatacaggtgctgcatggctgtcgtcagctcgtgttgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggatgctacacagcgaggtcatgctaatctcaaaaagccgatcgtagtccggattggagtctgcaactcgactccatgaagtcggaatcgctagtaatcgcggatcagaatgccgcggtgaatacgtt

SEQ ID NO: 42 - DNA, 1540 bp, Acinetobacter sp.
  RUH2624
tttaactgaagagtttgatcatggctcagattgaacgctggcggcaggcttaacacatgcaagtcgagcgggggaaggtagcttgctaccggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgcaagcctgatccagccatgccgcgtgtgtgaagaaggccttatggttgtaaagcactttaagcgaggaggaggctactttagataatacctagagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctcctta

SEQ ID NO: 43 - DNA, 1540 bp, Acinetobacter sp.
  SH024
tttaactgaagagtttgatcatggctcagattgaacgctggcggcaggcttaacacatgcaagtcgagcggagagaggtagcttgctactgatcttagcggcggacgggtgagtaatgcttaggaatctgcctattagtgggggacaacatttcgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgcaagcctgatccagccatgccgcgtgtgtgaagaaggccttatggttgtaaagcactttaagcgaggaggaggctactttagataatacctagagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctcctta

SEQ ID NO: 44 - DNA, 1362 bp, Actinobacillus actinomycetemcomitans
attgaacgctggcggcaggcttaacacatgcaagtcggacggtagcaggagaaagcttgctttcttgctgacgagtggcggacgggtgagtaatgcttggggatctgtcttatggagggggataacgacgggaaactgtcgctaataccgcgtagagtcgggagacgaaagtgcgggaccttagggccgcatgccatgagatgagcccaagtgtgattaggtagttggtggggtaaaggcctaccaagccgacgatcgctagctggtctgagaggatggccagccacaccgggactgagacacggcccggactcctacgggaggcagcagtggggaatattgcgcaatgggggcaaccctgacgcagccatgccgcgtgaatgaagaaggccttcgggttgtaaagttctttcggtgatgaggaaggttggtgtgttaatagcatgccaacttgacgttaaatacagaagaagcaccggctaactccgtgccagcagccgcggtaatacggggggtgctagcgttaatcggaataactgggcgtaaagggcacgtaggcggacctttaagtgaggtgtgaaatccccgggcttaacctgggaattgcatttcatactgggggtctggagtactttagggaggggtagaattccacgtgtagcggtgaaatgcgtagagatgtggaggaataccgaaggcgaaggcagccccttggggatgtactgacgctgatgtgcgaaagcgtggggagcaaacaggattagataccctggtagtccacgctgtaaacggtgtcgatttggggattggggtttagccctggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccgaagaagaactcagagatgggtttgtgccttagggagctttgagacaggtgctgcatggctgtcgtcagctcgtgttgtgaaatgttgggttaagtcccgcaacgagcgcaacccttatcctttgttgccagcgattaggtcgggaactcaaaggagactgccggtgataaaccggaggaaggtggggatgacgtcaagtcatcatggcccttacgagtagggctacacacgtgctacaatggcgtatacagagggtaaccaaccagcgatggggagtgaatctcagaaagtgcgtctaagttcggattggagtctgcaactcgactccatgaagtcggaatcgctagtaatcgcgaatcagaatgttgcggtgaatacgttcccgggcctt

SEQ ID NO: 45 - DNA, 1542 bp, Actinobacillus minor
gaattgaagagtttgatcatggctcagattgaacgctggcggcaggcttaacacatgcaagtcgaacggtaacagggagaaagcttgctttctttgctgacgagtggcggacgggtgagtaatgcttgggaatctggcttatggagggggataactacgggaaactgtagctaataccgcgtaatatcttcggattaaagggtgggaccgtaaggccacctgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaaggcaggtaagttaatagcttacttgattgacgttagtcacagaagaagcaccggctaactccgtgccagcagccgcggtaatacggagggtgcgagcgttaatcggaatgactgggcgtaaagggcacgcaggcggtgacttaagtgagatgtgaaagccccgggcttaacctgggaattgcatttcatactgggtcgctagagtattttagggaggggtagaattccacgtgtagcggtgaaatgcgtagagatgtggaggaataccgaaggcgaaggcagccccttgggaatatactgacgctcatgtgcgaaagcgtggggagcaaacaggattagataccctggtagtccacgctgtaaacgctgtcgatttggggattgggctttgagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccaaagaagaactcagagatgagtttgtgccttcgggaactttgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgtatacagagggaagcaatatggcgacatggagcaaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaacggaaacgggggcgtttaccacggtatgattcatgactggggtgaagtcgtaacaaggtaaccgtaggggaacctgcggttggatcacctcctta

SEQ ID NO: 46 - DNA, 1538 bp, Actinobacillus pleuropneumoniae
gaattgaagagtttgatcatggctcagattgaacgctggcggcaggcttaacacatgcaagtcgaacggtaacgggaagggagcttgctttctttgccgacgagtggcggacgggtgagtaatgcttgggaatctggcttatggagggggataactacgggaaactgtagctaataccgcgtaatatctatggattaaagggtgggactttcgggccacctgccataagatgagcccaagtgggattaggtagttggttaggtaaaggctgaccaagccgacgatctctagctggtctgagaggatgaccagccacactggaactgagacacggtccagactcctacgggaggcagcagtggggaatattgcacaatgggggggaacctgatgcagccatgccgcgtgaatgaagaaggccttcgggttgtaaagttctttcggtagcgaggaaggtatcaaatttaatagatttggtaattgacgttaactacagaagaagcaccggctaactccgtgccagcagccgcggtaatacggagggtgcgagcgttaatcggaataactgggcgtaaagggcacgcaggcggtgtgattaagtgagatgtgaaagccccgggcttaacctgggattgcattacatactggtcaactagagtactttagggagggggagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattggactgtgagtctggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatacgagagtgccttcgggaaccatgagacaggtgctgcatggctgtcgtcagctcgtgttgtgaaatgttgggttaagtcccgcaacgagcgcaacccttatcctttgttgccagcgattaggtcgggaactcaaaggagactgccggtgataaaccggaggaaggtggggatgacgtcaagtcatcatggcccttacgagtagggctacacacgtgctacaatggcgtatacagagggaagcaagatggcgacatggagcaaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccgaaaggggggcgtttaccacggtatgattcatgactggggtgaagtcgtaacaaggtaaccgtaggggaacctgcggttggatcacctc

SEQ ID NO: 47 - DNA, 1536 bp, Actinobacillus succinogenes
agagtttgatcatggctcagattgaacgctggcggcaggcttaacacatgcaagtcgaacggtaacgggtggaaagcttgctttccatgctgacgagtggcggacgggtgagtaatgcttggggatctggcttatggagggggataacgacgggaaactgtcgctaataccgcgtaatgtctaaggactaaagggtgggattttcggaccgcccgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcgcaatgggggcaaccctgacgcagccatgccgcgtgaatgaagaaggccttcgggttgtaaagttctttcggtggtgaggaaggcgaataagttaacagcttattcgattgacgttagccacagaagaagcaccggctaactccgtgccagcagccgcggtaatacggagggtgcgagcgttaatcggaataactgggcgtaaagggcacgcaggcggctatttaagtgagatgtgaaatccccgggcttaacctgggaactgcatttcagactgggtagctagagtactttagggaggggtagaattccacgtgtagcggtgaaatgcgtagagatgtggaggaataccgaaggcgaaggcagccccttgggaacgtactgacgctcatgtgcgaaagcgtggggagcaaacaggattagataccctggtagtccacgctgtaaacgctgtcgatttggggattgggcgataagcctggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctcagaatccggtagagatatcggagtgccttcgggaactgagagacaggtgctgcatggctgtcgtcagctcgtgttgtgaaatgttgggttaagtcccgcaacgagcgcaacccttatcctttgttgccagcatgtagagatgggaactcaaaggagactgccggtgataaaccggaggaaggtggggatgacgtcaagtcatcatggcccttacgagtagggctacacacgtgctacaatggcgtatacagagggaaacgagcctgcgagggggagtgaatctcagaaagtgcgtcgtagtccggattggagtctgcaactcgactccatgaagtcggaatcgctagtaatcgcgaatcagcatgtcgcggtgaatacgttcccgggccttgtacacaccgcccgtcacaccatgggagtgggttgtaccagaagtagatagcttaaccgaaagggggggcgtttaccacggtatgattcatgactggggtgaagtcgtaacaaggtaaccgtaggggaacctgcggttggatcacctcctt

SEQ ID NO: 48 - DNA, 1543 bp, Actinobacillus ureae
ttgaattgaagagtttgatcatggctcagattgaacgctggcggcaggcttaacacatgcaagtcgaacggtaacagggattagcttgctaatttgctgacgagtggcggacgggtgagtaatgcttgggaatttggctcatggagggggataactacgggaaactgtagctaataccgcgtaatatcttaggattaaagtgtgggaccgcaaggccacatgccatgagatgagcccaagtgggattaggtagttggtggggtaaaggcctaccaagccgacgatctctagctggtctgagaggatgatcagccacactggaactgagacacggtccagactcctacgggaggcagcagtggggaatattgcacaatgggggggaccctgatgcagccatgccgcgtgaatgaagaaggccttcgggttgtaaagttctttcggtagcgaggaaggtatcaaatttaatagatttggtaattgacgttaactacagaagaagcaccggctaactccgtgccagcagccgcggtaatacggagggtgcgagcgttaatcggaataactgggcgtaaagggcacgcaggcggttgattaagtgagatgtgaaagccctgggcttaacctgggaattgcatttcatactggtcaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggctttgagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatacgagagtgccttcgggaaccatgagacaggtgctgcatggctgtcgtcagctcgtgttgtgaaatgttgggttaagtcccgcaacgagcgcaacccttatcctttgttgccagcgatttggtcgggaactcaaaggagactgccagtgataaactggaggaaggtggggatgacgtcaagtcatcatggcccttacgagtagggctacacacgtgctacaatggcgtatacagagggaagcaatatggcgacatggagcaaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccgcaaggggggcgtttaccacggtatgattcatgactggggtgaagtcgtaacaaggtaaccgtaggggaacctgcggttggatcacctccttac

SEQ ID NO: 49 - DNA, 1500 bp, Actinobaculum massiliae
agtttgatcctggctcaggacgaacgctggcggcgtgcttaacacatgcaagtcgaacggaaaggcccttccttttttggttgggtgctcgagtggcgaacgggtgagtattacgtgagtaacctgccctcaactgtgggataagcctgggaaactgggtctaatactgcatattcttctttcaccgcatggtgggggttggaaagttttttcggttggggatgggctcgcggcctatcagcttgttggtggggtgatggcctaccaaggcggtgacgggtagccggcctgagagggtggtcggccacattgggactgagatacggcccagactcctacgggaggcagcagtgggggatattgcacaatgggcgcaagcctgatgcagcgacgccgcgtgagggatgaaggctttcgggttgtaaacctctttcggtacagaacaaggcacgttttttgcgtgtggagggtatgtgcagaagaagcgccggctaactacgtgccagcagccgcggtaatacgtagggcgcgagcgttgtccggaattattgggcgtaaagggctcgtaggcggcttgttgcgcctgctgtgaaaacgcggggcttaactccgcgcgtgcagtgggtacgggcaggcttgagtgtggtaggggtgactggaattccrggtgtagcggtggaatgcgcagatatctggaggaacaccgatggcgaaggcaggtcactgggccattactgacgctgaggagcgaaagcgtgggtagcgaacaggattagataccctggtagtccacgctgtaaacgttgggaactaggtgtggggcccttttccggggttctgcgccgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatacaccgggagcatgcagagatgtgtgtgcctttttggctggtgtacaggtggtgcatggttgtcgtcagctcgtgtcgtgagatgttgggttaagtcccgcaacgagcgcaacccttgtctcgtgttgccagcgcgttatggtggggactcacgagagactgccggggttaactcggaggaaggtggggatgacgtcaaatcatcatgccccttatgtcttgggcttcacgcatgctacaatggccggtacagtgggttgcgatactgtgaggtggagcgaatctctgaaagccggtctcagttcggatcggggtctgcaactcgacctcgtgaagtcggagtcgctagtaatcgcggatcagcattgccgcggtgaatacgttcccgggccttgtacacaccgcccgtcacgtcacgaaagttggcaacacccgaagcccgtggcctaaccttttggggggagcggtcgaaggtggggttggcgattgggacgaagtcgtaacaaggtagccgta

SEQ ID NO: 50 - DNA, 1487 bp, Actinobaculum schaalii
ggttcaggacgaacgctggcggcgtgcttaacacatgcaagtcgaacgatgaaacctagcaatctttggttgttgggtggattagtggcgaacgggtgagtaatacgtgggtaacctgccctcctttttgggataagccttggaaacggggtctaataccgaatattctggatgattcgcatggattgtttgggaaagcttttgtgaagggggatgggctcgcggcctatcagcttgttggtggggtgatggcctaccaaggcggtgacgggtagccggcctgagagggtgaccggccacattgggactgagatacggcccagactcctacgggaggcagcagtgggggatattgcacaatgggcgaaagcctgatgcagcgacgccgcgtgggggatgaaggctttcgggttgtaaacctctttcgctatcgaacaaggctcactatagggtgggttgagggtaggtggagaagaagcgccggctaactacgtgccagcagccgcggtaatacgtagggcgcgagcgttgtccggaattattgggcgtaaagggcttgtaggcggcttgttgcgcctgctgtgaaaacgcggggcttaacttcgcgcgtgcagtgggtacgggcaggcttgagtgtggtaggggtgactggaattccaggtgtagcggtggaatgcgcagatatctggaggaacaccgatggcgaaggcaggtcactgggccattactgacgctgaggagcgaaagcatgggtagcgaacaggattagataccctggtagtccatgctgtaaacgttgggaactaggtgtggggggcctttccaggttttctgcgccgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatacaccgcggggctgcagagatgtggttgcatttggttggtggtgtacaggtggtgcatggttgtcgtcagctcgtgtcgtgagatgttgggttaagtcccgcaacgagcgcaacccttgtctcgtgttgccagcatgttgtggtggggactcacgagagactgccggggttaactcggaggaaggtggggatgacgtcaaatcatcatgccccttatgtcttgggcttcacgcatgctacaatggccggtacagagggttgcgatatcgtaaggtggagckaatcccttaaagctggtctcagttcggatcggggtctgcaactcgacctcgtgaagtcggagtcgctagtaatcgcggatcagcattgccgcggtgaatacgttcccgggccttgtacacaccgcccgtcacgtcacgaaagttggtaacacccgtagctcgtggcctaaccattttatgtggggggagcggtcgaaggtggggctggcgattgggacgaagtcgtaa

SEQ ID NO: 51 - DNA, 1283 bp, Actinobaculum sp.
  BM#101342
atggaaacggggtctaatactggatattcctgtctggtcgcatggctgggtggggaaagttttttcggtgggggatgggctcgcggcctatcagcttgttggtggggtgatggcctaccaaggcgtcgacgggtagccggcctgagagggtgaccggccacactgggactgagatacggcccagactcctacgggaggcagcagtgggggatattgcacaatgggcgcaagcctgatgcagcgacgccgcgtgggggatgacggctttcgggttgtaaacctctttcgtcgggggacaaggctctgcttggtggtggggttgagggtacccggtgaagaagcgccggctaactacgtgccagcagccgcggtaatacgtagggcgcgagcgttgtccggaattattgggcgtaaagggctcgtaggcggcttgtcgcgtctgctgtgaaaatgcggggcttaactccgtacgtgcagtgggtacgggcaggctagagtgcggtaggggtgactggaattcctggtgtagcggtggaatgcgcagatatcaggaggaacaccgatggcgaaggcaggtcactgggctgttactgacgctgaggagcgaaagcgtggggagcgaacaggattagataccctggtagtccatgctgtaaacgttgggaactaggtgtggggttctttccacggattctgcgccggagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatacgctgggacggtgcagagatgtgctggcttttgctggtgtacaggtggtgcatggttgtcgtcagctcgtgtcgtgagatgttgggttaagtcccgcaacgagcgcaacccttgtctcgtgttgccagcaggttgggctggggactcacgggagactgccggggttaactcggaggaaggtggggatgacgtcaaatcatcatgccccttatgtcttgggcttcacgcatgctacaatggccggtacagagggttgcgatatcgtgaggtggagcgaatcccttaaagtcggtctcagttcggatcggggtctgcaactcgaccccgtgaagtcggagtcgctagtaatcgcggatcagcaacgccgcggtgaatacgttctcgggccttgtacacaccgcccgtcacgtcacgaaagttggcaacacccgaagctcgtggc

SEQ ID NO: 52 - DNA, 1313 bp, Actinobaculum sp.
  P2P_19 P1
gacgaacgctggcggcgtgcttaacacatgcaagtcgaacgagtggcgaacgggtgagtaatacgtgagtaacctgccctcttctttgggataagccttggaaacggggtctaatactggatattgaaagcggtgggggatgggctcgcggcctatcagcttgttggtggggtgatggcctaccaaggcgtcgacgggtagccggcctgagagggtgaccggccacactgggactgagatacggcccagactcctacgggaggcagcagtgggggatattgcacaatgggcgcaagcctgatgcagcgacgccgcgtgggggatgacggctttcgggttgtaaacctctttcgtcgggggacatgagggtacccggtgaagaagcgccggctaactacgtgccagcagccgcggtaatacgtagggcgcgagcgttgtccggaattattgggcgtaaagggctcgtaggcggcttgtcgcgtctgctgtgaaaatgcggggcttaactccgtacgtgcagtgggtacgggcaggctagagtgcggtaggggtgactggaattcctggtgtagcggtggaatgcgcagatatcaggaggaacaccgatggcgaaggcaggtcactgggctgactgacgctgaggagcgaaagcgtggggagcgaacaggattagataccctggtagtccatgctgtaaacgttgggaactaggtgtggggtattctgcgccggagctaacgcattaagttccccgcctggggagtacggccgcaaggctaaaactcaaagggattgacgggggcccgcacaagcggcggagcatgcggattaattcgatgcaacgcgaagaaccttaccaaggcttgacatatacaggtggtgcatggttgtcgtcagctcgtgtcgtgagatgttgggttaagtcccgcaacgagcgcaacccttgtctcgtgttgccagcagctggggactcacgggagactgccggggttaactcggaggaaggtggggatgacgtcaaatcatcatgccccttatgtcttgggcttcacgcatgctacaatggccggcagagggttgcgatatcgtgaggtggagcgaatccctttcggtctcagttcggacggggtctgcaactcgaccccggaagtcggagtcgctagtaatcgcggatcagcaacgccgcggtgaatacgttctcgggccttgtacacaccgcccgtcacgtcacgaaagttggcaacacccgaagctcgtgcctagggagcggtcgaaggtggggttggcgattgggacgaagtcgtaacaaggta

SEQ ID NO: 53 - DNA, 1526 bp, Actinomyces cardiffensis
gagtttgatcctggctcaggacgaacgctggcggcgtgcttaacacatgcaagtcgaacgatgatgcggtgcgtgcaccgttgattagtggcgaacgggtgagtaacacgtgagtaacctgccctcttctttgggataacggtctgaaagggctgctaatactgaatattcacatgtcttcgcatgggggtgtgtggaaagagatgcttttgggtgtttttggtgggggatgggctcgcggcctatcagcttgttggtggggtagtggcctaccaaggctttgacgggtaaccggcctgagagggtgaccggtcacattgggactgagatacggcccagactcctacgggaggcagcagtggggaattttgcacaatggacgcaagtctgatgcagcgacgccgcgtgagggatgtaggccttcgggttgtgaacctctttcgctcatggtcaagccgcagctttgggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggctggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccctgacgctgcagagatgtggtggcatttggttgggggtgtacaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggctggtacagagggttgcgatgtcgtaaggcggagcgaatcccttaaagctggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagctcatggcctaaccggtttgtctggggggagtggtcgaaggtgggattggcgattgggacgaagtcgtaacaaggtagccgtaccggaaggtgc

SEQ ID NO: 54 - DNA, 1410 bp, Actinomyces europaeus
  modified_base (318)..(318): a, c, t, g, unknown or other
  modified_base (325)..(325): a, c, t, g, unknown or other
cctggctcaggacgaacgctggcggcgtgcttaacacatgcaagtcgaacgggatccaaaggctttttgtttttggtgagagtggcgaacgggtgagtaacacgtgagtaacctgcccccttcttttggataaccgcatgaaagtgtggctaatacaggatattccaggctggtcgcatgattggtttgggaaatggtttggtctggtgggggatgggctcgcggcctatcagcttgttggtggggtgatggcctaccaaggcggtgacgggtagccggcctgagagggtgggcggtcacactgggactgagatacgncccagantcctacgggaggcagcagtgggggattttgcacaatgggcgcaagcctgatgcagcgacgccgcgtgagggatgaaggccttcgggttgtaaacctctttcgctgggttgaaaggccatgctttgggtgtggttgatttgaactggtaaagaagtaccggctaactacgtgccagcagccgcggtaatacgtagggtactagcgttgtccggatttattgggcgtaaagggcttgtaggtggtttgtcgcgtctgtcgtgaaatcctgtggcttaaccatgggcttgcggtgggtacgggcaggcttgagtgcggtaggggagactggaattcctggtgtagcggtggaatgcgcagatatcaggaggaacaccggtggcgaaggcgggtctctgggccgttactgacactgaggagcgaaagcgtggggagcgaacaggattagataccctggtagtccatgctgtaaacgttgggcactaggtgtgggggccgtgtggtttctgcgccgtagctaacgcattaagtgtcccgcctggggagtacggccgcaaggctaaaactcaaaggaattgacggggacccgcacaagcggcggagcatgcggattaattcgatgcaacgcgaagaaccttaccaaggcttgacatgcaccggtacagtgtagagatatgctggcctttttggctggtgtgcaggtggtgcatggttgtcgtcagctcgtgtcgtgagatgttgggttaagtcccgcaacgagcgcaacccttgtctcgtgttgccagcatttggttggggactctcgagagactgccggggttaactcggaggaaggtggggatgacgtcaaatcatcatgccccttatgtcttgggcttcacgcatgctacaatggatggtacagagggttgcgatactgtgaggtggagctaatcccttaaagctgttctcagttcggatcgtagtctgcaactcgactacgtgaaggtggagtcgctagtaatcgcagatcagcaacgctgcggtgaatacgttctcgggtcttgtacacaccgcccgtcacgtcacgaaagttggtaacacccgaa

SEQ ID NO: 55 - DNA, 1503 bp, Actinomyces funkei
atcatggctcaggacgaacgctggcggcgtgcttaacacatgcaagtcgaacggactggccttgagcttgcttggggttggtgagtggcgaacgggtgagtaacacgtgagtaacctgccctcttctttgggataacggtcggaaacggctgctaatactggatattcactcattggcgcatgttggtgggtggaaagatgcacttttggtgtttttggtgggggatgggctcgcggcctatcagcttgttggtggggtgatggcctaccaaggctttgacgggtaaccggcctgagagggtgaccggtcacattgggactgagatacggcccagactcctacgggaggcagcagtggggaattttgcacaatgggcgcaagcctgatgcagcgacgccgcgtgagggatggaggccttcgggttgtgaacctctttcgctcatggtcaagccgcgactttgggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggtcgacttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcatcctgagccttcagagatggaggtgcatttggttgggggtgtgcaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggctggtacagagggttgcgatgctgtgaggcggagcgaatcccttaaagccggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagctcatggcctaaccgcctttttggtggggggagtggtcgaaggtgggattggcgattgggacgaagtcgtaacaa

SEQ ID NO: 56 - DNA, 1326 bp, Actinomyces sp.
  C1
gacgaacgctggcggcgtgcttaacacatgcaagtcgaacgagtggcgaacgggtgagtatcacgtgagtaacctgcccttcggtcctggataaccgcttgaaagggcggctaatacggggtggtgatagtcggcgggggatgggctcgcggcctatcagcttgttggtggggtgatggcctaccaaggcggtgacgggtagccggcctgagagggtgggcggccacactgggactgagatacggcccagactcctgcgggaggcagcagtggggggtattgcacaatgggcggaagcctgatgcagcgacgtcgcgtgagggatggaggccttcgggttgtgaacctctgtttccggtggtgatgacggtagccggggatgaagcgccggctaactacgtgccagcagccgcggtaatacgtagggcgcgagcgttgtccggaattattgggcgtaaagggcttgtaggcggctggtcgcgtctgccgtgaaattctccggctcaaccgggggcttgcggtgggtacgggccagctggagtgcggtaggggaggctggaactcctggtgtagcggtggaatgcgcagatatcaggaggaacaccggtggcgaaggcgggtctctgggccgactgacgctgaggagcgaaagcgtggggagcgaacaggattagataccctggtagtccacgccgtaaacgttgggcactaggtgtgggccggtccgcgccgcagctaacgcattaagtgccccgcctggggagtacggccgcaaggctaaaactcaaaggaattgacgggggcccgcacaagcgacggagcatgcggattaattcgatgcaacgcgaagaaccttaccagggcttgacatgtgcaggtggtgcatggttgtcgtcagctcgtgtcgtgagatgttgggttaagtcccgcaacgagcgcaacccctgtcccgtgttgccagcgcgcggggactctcgggagactgccggggtcaactcggaggagggtggggacgacgtcaaatcatcatgcccctgacgtcctgggcttcacgcatgctacaatggccggcagagggttgcgatgccgtgaggcggggcgaatcccttccggtctcagttcggacggtgtctgcaactcgacaccggaagtcggagtcgctagtaatcgcagatcagcattgctgcggtgaatacgttctcgggccttgtacacaccgcccgtcacgtcatgaaagtcggtgacgcccgaagcccgtgcgagcggtcgaaggcggggccggtgattgggacgaagtcgtaacaaggtagccgtaccggaaggtgc

SEQ ID NO: 57 - DNA, 1331 bp, Actinomyces sp.
  C2
gacgaacgctggcggcgtgcttaacacatgyaagtcgaacgagtggcgaacgggtgagtaacacgtgagtaacctgcccccttctttgggataacgcccggaaacgggtgctaatactggatattgaaagctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgcaagcctgatgcagcgacgccgcgtgagggatggaggccttcgggttgtgaacctctttcgctcatggtcatgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggctgacttgagtgcggtaggggagactggaactcctggtgtagcggtggaatgcgcagatatcaggaagaacaccggtggcgaaggcgggtctctgggccgactgacgctgaggagcgaaagcgtggggagcgaacaggattagataccctggtagtccacgctgtaaacgttgggcactaggtgtgggggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgtgcaggtggtgcatggttgtcgtcagctcgtgtcgtgagatgttgggttaagtcccgcaacgagcgcaacccttgccctatgttgccagcacgtggggactcgtgggggactgccggggttaactcggaggaaggtggggatgacgtcaaatcatcatgccccttatgtcttgggcttcacgcatgctacaatggttggcagagggttgcgatactgtgaggtggagcgaatcccttccagtctcagttcggatggggtctgcaactcgaccccagaaggtggagtcgctagtaatcgcagatcagcaacgctgcggtgaatacgttctcgggccttgtacacaccgcccgtcacgtcacgaaagttggtaacacccgaagcccatgcctagggagtggtcgaaggtgggattggcgattgggacgaagtcgtaacaaggtagccgtaccggaaggtgc

SEQ ID NO: 58 - DNA, 1290 bp, Actinomyces sp.
  P1 oral clone MB6_C03
gacgaacgctggcggcgtgcttaacacatgcaagtcgaacgagtggcgaacgggtgagtatcacgtgagtaacctgccctcctctcctggataaccgcttgagagggcggctaatacggggtggtgatagtcggtgggggatgggctcgcggcctatcagcttgttggtggggtgatggcccaccaaggcggtgacgggtagccggcctgagagggtgggcggccacactgggactgagacacggcccagactcctgcgggaggcagcagtggggggtattgcacaatgggcggaagcctgatgcagcgacgtcgcgtgagggatggaggccttcgggttgtgaacctctgttcccggtggtgatgacggtagccgggtatgaagcgccggctaactacgtgccagcagccgcggtaatacgtagggcccaagcgttgtccggaattattgggcgtaaagggcttgtaggcggccggccgcgtccgtcgtgaaatcctccggctcaaccgggggcttgcggtgggtacgggtcggctggagtgcggcaggggaggctggaactcctggtgtagcggtggaatgcgcagatatcaggaggaacaccggtggcgaaggcgggtctctgggccgactgacgctgaggagcgaaagcgtggggagcgaacaggattagataccctggtagtccacgccgtaaacgttgggcactaggtgtggggcgctccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccagggcttgacatgcgcaggtggtgcatggttgtcgtcagctcgtgtcgtgagatgttgggttaagtcccgcaacgagcgcaacccctgtcccgtgttgccagcgcgcggggactctcgggagactgccggggtcaactcggaggagggtggggacgacgtcaaatcatcatgcccctgacgtcctgggcttcacgcatgctacaatggccggcagagggttgcgatgccgcgaggcggggcgaatcccttccggtctcagttcggacggtgtctgcaactcgacaccggaagtcggagtcgccagtaatcgcagatcagcactgctgcggtgaatacgttctcgggccttgtacacaccgcccgtcacgtcatgaaagtcggcgacgcccgaagcccgtgcgagcggtcgaaggcggggccggtgattggg

SEQ ID NO: 59 - DNA, 1427 bp, Actinomyces georgiae
acacatgcagtcgaacgctgaagcctggctttgtgttgggtggatgagtggcgaacgggtgagtaacacgtgagtaacctgccctcttcttcgggataacggtctgaaagggctgctaataccgggtattcactggtcctcgcatgggggttggtggaaaggttttttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcggaagcctgatgcagcgacgccgcgtgagggatggaggccttcgggttgtgaacctctttcgcccgtggtcaagccgcaactgtgggttgtggtgagggtagtgggtaaagaagcgccggctaactacgtgccagcagccgcggtaatacgtagggcgcgagcgttgtccgggaattattgggcgtaaagggcttgtaggcggctggtcgcgtctgccgtgaaatcctctggctcaactgggggcgtgcggtgggtacgggctggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttccgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccccgggcgcgcggagacgcgcgcgcatttggttgggggtgtgcaggtggtgcatggttgtcgtcagctcgtgtcgtgagatgttgggttaagtcccgcaacgagcgcaacccttgccctatgttgccagcgcgttatggcggggactcgtgggggactgccggggttaactcggaggaaggtggggatgacgtcaaatcatcatgccccttatgtcttgggcttcacgcatgctacaatggctggtacagagggttgcgatgccgtgaggcggggcgaatcccttaaagccggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacgcccgaagcccatggcccaaccggctcttgctggggggagtggtcgaaggtgg

SEQ ID NO: 60 - DNA, 1446 bp, Actinomyces israelii
cgtgcttaacacatgcaagtcgaacgggtctgccttgttttttgcggggtgggtcagtggcgaacgggtgagtaacacgtgagtaacctgcccctcacttctggataaccgcttgaaagggtggctaatacggggtgttctggctgtgccgcatggtgtggctgggaaagattcacttttgtggtgttttggtgggggatgggctcgcggcctatcagcttgttggtggggtgatggcctgccaaggctttgacgggtagccggcctgagagggtgggcggtcacactgggactgagatacggcccagactcctgcgggaggcagcagtggggggtattgcacaatgggcggaagcctgatgcagcgacgtcgcgtgagggatggaggccttcgggttgtgaacctctttcgccggtgaagaaggtcctgttctttgtggtggggctgacggtagccgggttatgaagcgccggctaactacgtgccagcagccgcggtaatacgtagggcgcgagcgttgtccggaattattgggcgtaaagggcttgtaggcggctggtcgcgtctgccgtgaaatcctctggctcagctgggggcgtgcggtgggtacgggctggcttgagtgcggtaggggaggctggaactcctggtgtagcggtggaatgcgcagatatcaggaggaacaccggtggcgaaggcgggtctctgggccgttactgacgctgaggagcgaaagcgtggggagcgaacaggattagataccctggtagtccatgctgtaaacgttgggcactaggtgtggggggtctttccgggtcctccgcgccgtagctaacgctttaagtgccccgcctggggagtacggccgcaaggctaaaactcaaaggaattgacgggggcccgcacaagcggcggagcatgcggattaattcgatgcaacgcgaagaaccttaccagggcttgacatgggccggctgctcctggagacgggggcctcccttttttgggccggttcacaggtggtgcatggttgtcgtcagctcgtgtcgtgagatgttgggttaagtcccgcaacgagcgcaacccctgtcccgtgttgccagcgtgttgtggcggggactcgcgggagactgccggggttaactcggaggagggtggggacgacgtcaaatcatcatgccccttatgtcctgggcttcacgcatgctacaatggccggtacagtgggttgcgatgtcgtgaggcggagcgaatcccttaaagccggtctcagttcggatcggtgtctgcaactcgacaccgtgaagctggagtcgctagtaatcgcagatcagcagtgctgcggtgaatacgttctcgggccttgtacacaccgcccgtcacgtcatgaaagccggcgacacccgaagcccgtggccctgtggggagcggtcgaaggtggggct

SEQ ID NO: 61 - DNA, 1520 bp, Actinomyces massiliensis
agagtttgatcctggctcaggacgaacgctggcggcgtgcttaacacatgcaagtcgaacgggccttgtccccttttttttgggggtggggttagtggcgaacgggtgagtaacacgtgagtaacctgcccctcacttctggataaccgcttgaaagggtggctaatacggggtgttctggcctgctcgcatgggtgggtttggaaagattcgaccggttttggttgttttggtgggggatgggctcgcggcctatcagcttgttggtggggtgatggcctgccaaggctttgacgggtagccggcctgagagggtgggcggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagaaggtcctgctctttgtggtggggttgacggtagctgggttaatgaagcgccggctaactacgtgccagcagccgcggtaatacgtagggcgcgagcgttgtccggaattattgggcgtaaagggcttgtaggcggctggtcgcgtctgccgtgaaatcctctggctcagctgggggcgtgcggtgggtacgggctggcttgagtgcggtaggggagactggaactcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtggggggccttttccgggttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggctggattgcttcggagacggggtttcccttttttgggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggttaactcggaggaaggtggggatgacgtcaaatcatcatgccccttatgtcttgggcttcacgcatgctacaatggccggtacagtgggttgcgatgctgtgaggcggagcgaatccctgaaagccggtctcagttcggatcggtgtctgcaactcgacaccgtgaagttggagtcgctagtaatcgcagatcagcagcgctgcggtgaatacgttctcgggccttgtacacaccgcccgtcacgtcatgaaagctggcaacacccgaagcccgtggccttatggggagcggtcgaaggtggggctggtgattgggacgaagtcgtaacaaggtaacc

SEQ ID NO: 62 - DNA, 1411 bp, Actinomyces meyeri
attgccaagttcgaaacgctgaagcctagcttgctgggtggatgagtggcgaacgggtgagtaacacgtgagtaacctgccctcttctttgggataacgcccggaaatgggtgctaatactggatattcactggtcttcgcatgggggttggtggaaagggtttttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgcaagcctgatgcagcgacgccgcgtgagggatggaggccttcgggttgtgaacctctttcgctcatggtcaagccgcaactgtgggttgtggtgagggtagtgggtaaagaagcgccggctaactacgtgccagcagccgcggtatacgtaggcgcgagcgttgtccgaattattgggcgtaaagggcttgtaggcggttggtcgcgtctgtcgtgaaatcctctggcttaactgggggcgtgcggtgggtacgggctggcttgagtgcggtaggagagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccctgggcgtgcggagacgtgcgtgcatttggttgggggtgtgcaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggttggtacagagggttgcgatatcgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccggtttttgctggggggggaag

SEQ ID NO: 63 - DNA, 1450 bp, Actinomyces naeslundii
tcctgactcaggacgaacgctgccggcgtacataacacatgcaagtcgaacggtgaaggggcctgcttttgtgggtcctggatgagtggcgaacgggtgagtaacacgtgagtaacctgcccccttcttctggataaccgcatgaaagtgtggctaatacgggatattctgggtctgtcgcatggtgggcctgggaaagattgcgccttttttggtgtttttggtgggggatgggctcgcggcctatcagcttgttggtggggtgatggcctgccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgcctcgtttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtctgctccggagacggggtttcctcctttgtgggggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgt

SEQ ID NO: 64 - DNA, 1328 bp, Actinomyces nasicola
gacgaacgctggcggcgtgcttaacacatgcaagtcgaacgagtggcgaacgggtgagtaacacgtgagtaacctgcccccttctttgggataactgccggaaacggtggctaatactggatattgaaagctggtgggggatgggctcgcggcctatcagcttgttggtggggtgatggcctaccaaggctttgacgggtagccggcctgagagggtgaccggccacactgggactgagacacggcccagactcctacgggaggcagcagtggggaatattgcacaatgggggaaaccctgatgcagcgacgccgcgtgagggatgacggccttcgggttgtaaacctctttcagtagggaagaagacggtacctgcagaagaagcgccggctaactacgtgccagcagccgcggtaatacgtagggcgcaagcgttgtccggaattattgggcgtaaagagctcgtaggcggcttgtcgcgtctgtcgtgaaaacctgcagcttaactgtgggcttgcggtgggtacgggctggcttgagtgcagtaggggagactggaattcctggtgtagcggtggaatgcgcagatatcaggaggaacaccggtggcgaaggcgggtctctgggctgactgacgctgaggagcgaaagcatggggagcgaacaggattagataccctggtagtccatgccgtaaacgttgggcactaggtgtggggatttctgtgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatatacaggtggtgcatggttgtcgtcagctcgtgtcgtgagatgttgggttaagtcccgcaacgagcgcaacccttgtctcatgttgccagcacgtggggactcatgagagactgccggggttaactcggaggaaggtggggatgacgtcaaatcatcatgccccttatgtcttgggcttcacgcatgctacaatggccggcagtgggttgcgatctcgtgagggggagctaatccttgccggtctcagttcggatggggtctgcaactcgaccccagaagtcggagtcgctagtaatcgcagatcagcaacgctgcggtgaatacgttctcgggccttgtacacaccgcccgtcacgtcacgaaagttggtaacacccgaagctcatgcctagggagtggtcgaaggtgggactggcgattgggacgaagtcgtaacaaggtagccgtaccggaagg

SEQ ID NO: 65 - DNA, 1489 bp, Actinomyces neuii
  modified_base (159)..(159): a, c, t, g, unknown or other
cgaacgctggcggcgtgcttaacacatgcaagtcgaacgggatccattagcgcttttgtgtttttggtgagagtggcgaacgggtgagtaacacgtgagtaacctgcccttttctttgggataagcctgggaaactgggtctaatactggatgttccgncttcctcgcatggggttgttgggaaaggttttttctggattgggatgggctcgcggcttatcagcttgttggtggggtgatggcttaccaaggctttgacgggtagccggcctgagagggtggtcggtcacactgggactgagatacggcccagactcctacgggaggcagcagtgggggatattgcacaatggacggaagtctgatgcaccgacgtcgtgtgggggatgaaggccttcgggttgtaaactcctttcgcccgcggaaaaggcagggttttggccttgttgatggtagtgggtaaagaagcgccggctcactacgtgccagcagccgcggtaatacgtagggcgcgagcgttgtccggaattattgggcgtaaagggctcgtaggcggtttgtcgcgtctagcgtttaaggctcgggcttaacccgggtttgcgttgggtacgggcaggcttgagtgcggtaggggtaactggaattcctggtgtagcggtggaatgcgcagatatcaggaggaacaccggtggcgaaggcgggttactgggccgttactgacgctgaggagcgagagcgtggggagcgaacaggattagataccctggtagtccatgctgtaaacgttgggcactaggtgtgggggctggtttcatggttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccgcgagactgcagagatgtggttgccttcggggtggtgtgcaggtggtgcatggttgtcgtcagctcgtgtcgtgagatgttggttaagtcccgcaacgagcgcaacccttgtctcatgttgccagcacgttatggtggggactcgtgagagactgccggggttaactcggaggaaggtggggatgacgtcaaatcatgatgccccatatgtcttgggcttcacgcatgctacagtggtgtctacagagggttgctattccgtgaggttgagcgaatctcttaaagggcatcttggttcggatcgcagtctgcaactcgactgcgtgaaggtggagtcgctagtaatcgcagatgagcattgctgcggtgaatacgttctcgggccttgtacacaccgcccgtcacgtcacgaaagttggtaacacccgaagcctgtggcctaacctttttggggggagtggtcgaaggtggggctagcgattgggacgaagtcgtaacaaggtagccgtaccggaagg

SEQ ID NO: 66 - DNA, 1548 bp, Actinomyces odontolyticus
tttgttcggagagtttgatcctggctcaggacgaacgctggcggcgtgcttaacacatgcaagtcgaacgctgaagcctagcttgctgggtggatgagtggcgaacgggtgagtaacacgtgagtaacctgcccccttctttgggataacgcccggaaacgggtgctaatactggatattcactggtcttcgcatgggggttggtggaaaggtttgttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatggaggccttcgggttgtaaacctctttcgctcatggtcaagccgcaacattggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggctgacttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgaaatcgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccgctttgtgtggggggagtggtcgaaggtgggattggcgattgggacgaagtcgtaacaaggtagccgtaccggaaggtgcggctggatcacctcctttctaggg

SEQ ID NO: 67 - DNA, 1508 bp, Actinomyces oricola
  modified_base (32)..(32): a, c, t, g, unknown or other
gacgaacgctggcggcgtgcttaacacatgcnagtcgaacgggccggccccttgttttttggggggttggttgagtggcgaacgggtgagtaacacgtgagtaacctgccctcttcttctggataaccgcatgaaagtgtggctaatacgggatattctggtctgcctgcatgggtgggttgggaaagattcactttggtgttttggtgggggatgggctcgcggcctatcagcttgttggtggggtgatggcctaccaaggcggtgacgggtagccggcctgagagggtgggcggtcacactgggactgagatacggcccagactcctacgggaggcagcagtgggggatattgcacaatgggcggaagcctgatgcagcgacgtcgcgtgagggatggaggccttcgggttgtgaacctctttcgccagtgaagtaggtctgctcctgtgtgggtgggttgacggtagctgggtttttaagaagcgccggctaactacgtgccagcagccgcggtgatacgtagggcgcgagcgttgtccggaattattgggcgtaaagggcttgtaggcggctggtcgcgtctgccgtgaaatcctctggcttaactgggggtgtgcggtgggtacgggtcggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccatgctgtaaacgttgggcactaggtgtggggggcctttccgggttttccgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgggctggtttggtctggagacaggccgtccctttttttggggctggttcacaggtggtgcatggttgtcgtcagctcgtgtcgtgagatgttgggttaagtcccgcaacgagcgcaacccttgtctcgtgttgccagcatgttgtggtggggactcgcgggagactgccggggttaactcggaggaaggtggggatgacgtcaaatcatcatgccccttatgtcttgggcttcacgcatgctacaatggccggtacagtgggttgcgatgtcgtgaggcggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccttatggggagcggtcgaaggtggggctggtgattgggacgaagtcgtaacaaggtagccgtaccggaagg

SEQ ID NO: 68 - DNA, 1517 bp, Actinomyces orihominis
tcaggacgaacgctggcggcgtgcttaacacatgcaagtcgaacgggcccgcccctgtttttgggggtgggttgagtggcgaacgggtgagtatcacgtgagtaacctgccccctgctcctggataactgcttgaaagggcggctaatacggggtgtgccggctggtccgcatgggcctggtcgggatagtttcatcttcgggtgtttcggtgggggatgggctcgcggcctatcagcttgttggtggggtgatggcccaccaaggcggtgacgggtagccggcctgagagggtgggcggccacactgggactgagacacggcccagactcctgcgggaggcagcagtggggggtattgcacaatgggcggaagcctgatgcagcgacgtcgcgtgagggatggaggccttcgggttgtgaacctctttctccggtggtgaaggccctgtccgttgcggcggggttgacggtagccgggtatgaagcgccggctaactacgtgccagcagccgcggtaatacgtagggcgcgagcgttgtccggaattattgggcgtgaagggcttgtaggcggccggtcgcgtccgccgtgaaattctccggctcaaccgggggcttgcggtgggtacgggccggctggagtgcggtaggggaggctggaactcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtggggccccgctcggcgggggtccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccagggcttgacatgggggcggcggcgccggagacggcgcctccctttttcgggcgcccccgcaggtggtgcatggttgtcgtcagctcgtgtcgtgagatgttgggttaagtcccgcaacgagcgcaacccctgtcccgtgttgccagcgcgtcgtggcggggactctcgggagactgccggggtcaactcggaggagggtggggacgacgtcaaatcatcatgcccctgacgtcctgggcttcacgcatgctacaatggccggtacagagggttgcgatgccgtgaggcggggcgaatcccttaaagccggtctcagttcggatcggtgtctgcaactcgacaccgtgaagtcggagtcgctagtaatcgcagatcagcattgctgcggtgaatacgttctcgggccttgtacacaccgcccgtcacgtcatgaaagtcggcgacgcccgaagcccgtggccccatggggagcggtcgaaggcggggccggtgattgggacgaagtcgtaacaaggtagccgtaccggaaggtgcggctgga

SEQ ID NO: 69 - DNA, 1535 bp, Actinomyces oris
agagtttgatcctggctcaggacgaacgctggcggcgtgcttaacacatgcaagtcgaacggtgaagggatcagcttgctggttctggatgagtggcgaacgggtgagtaacacgtgagtaacctgcccccttcttctggataaccgcatgaaagtgtggctaatacgggatattctgggtctgtcgcatgacgggtctgggaaagatgcgcctttgggtgtttttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcccgcctcttttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtgggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtagccgtaccggaaggtgcggctg

SEQ ID NO: 70 - DNA, 1464 bp, Actinomyces sp.
  7400942
gacgaacgctggcggcgtgcttaacacatgcaagtcgaacggtgaagctcctggcttttgttgggggtggatgagtggcgaacgggtgagtaacacgtgagtaacctgcccctttcttctggataccgccacgaaagtggtgttaatacgggatattctggcyctgtcgcatggkggggttgggaaaggtcttttctggtgggggatgggctcgcggcctatcagcttgttggtggggtgatggcctaccaaggcgttgacgggtagccggcctgagagggtggacggccacactgggactgagacacggcccagactcctacgggaggcagcagtggggaatattgcacaatgggcggaagcctgatgcagcgacgccgcgtgagggatggaggccttcgggttgtgaacctctttcgccagtgaagcaggcccgctccttgtgggtgggttgacggtagctggataagaagcgccggctaactacgtgccagcagccgcggtaatacgtagggcgcgagcgttgtccggaattattgggcgtaaagggcttgtaggcggctggtcgcgtctgccgtgaaatcccctggcttaactgggggcgtgcggtgggtacgggccggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtggggggcctttccgggtcctccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtcggcgattcccgcggagacgcggtctccccctcgtggggcgccgtcacaggtggtgcatggttgtcgtcagctcgtgtcgtgagatgttgggttaagtcccgcaacgagcgcaacccctgtcccgtgttgccagcacgtcgtggtggggactcgcgggagactgccggggtcaactcggaggagggtggggatgacgtcaaatcatcatgccccttatgtcttgggcttcacgcatgctacaatggccggtacagagggttgcgatgccgcgaggcggggcgaatcccttaaagccggtctcagttcggatcggtgtctgcaactcgacaccgtgaagttggagtcgctagtaatcgcggatcagcaacgccgcggtgaatacgttctcgggccttgtacacaccgcccgtcacgtcatgaaagtcggcaacacccgaagcccgtggccccatggggagcggtcgaaggtggggccggtgattgggacg

SEQ ID NO: 71 - DNA, 1367 bp, Actinomyces sp.
  CCUG 37290
  modified_base (671)..(671): a, c, t, g, unknown or other
  modified_base (1259)..(1259): a, c, t, g, unknown or other
acgaacgctggcggcgtgcttaacacatgcaagtcgaacgctgaagacctggcttttgttgggttggatgagtggcgaacgggtgagtaacacgtgagtaacctgccctcttctttgggataacgcccggaaacgggtgctaatactggatattcactggccttcgcatgggggttggtggaaaggtttgttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatggaggccttcgggttgtaaacctctttcgctcatggtcaagccgcaactgtgggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaattctctggcttaactgggggcgtgcggtgggtacgggctgacttgagtgcggtaggggagactggaactcctggtgtagcggtggaatgcgcanatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttggttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgatactgtgaggtggagcgaatcccttaaanccagtctcagttcggattggggtctgcaactcgaccccatgaaggtggagtcgctagtaatcgcagatcagcaacgctgcggtgaatacgttctcgggccttgtacac

SEQ ID NO: 72 - DNA, 1501 bp, Actinomyces sp.
  ChDC B197
agagtttgatcctggctcagacgaacgctggcggcgtgcttaacacatgcaagtcgaacggtgaagggaccagcttgctggttctggatgagtggcgaacgggtgagtaacacgtgagtaacctgcccccttcttctggataaccgcatgaaagtgtggctaatacgggatattctgggtctgtcgcatgacgggcccgggaaagatattgcttcggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtaaacctctttcgccagtgaagcaggcctgctccttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactagtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggcttcctccttgtggggccggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagctggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtaacc

SEQ ID NO: 73 - DNA, 1274 bp, Actinomyces sp.
  GEJ15
  modified_base (398)..(400): a, c, t, g, unknown or other
  modified_base (450)..(450): a, c, t, g, unknown or other
taacctgccctcttcttctggataacctcatgaaagtggggctaatacggggtattccgggtctgtcgcatggcgggtttgggaaagattgcgcctttgggtgttttcggtgggggatgggctcgcggcctatcagcttgttggtggggtgatggcctaccaaggcggtgacgggtagccggcctgagagggtggacggccacactgggactgagacacggcccagactcctgcgggaggcagcagtggggaatattgcacaatgggcgcaagcctgatgcagcgacgccgcgtgagggatggaggccttcgggttgtgaacctctttcgccagtgaagcaggcctgctcgttgtcgtggtgacgtagctgatagagcgcgctactacgtgcagcagnnngtatacgtaggcgcgagcgtgtcagtaagtatgggcgtaaagagctcgtngcgctggtcgcgtctgtcgtgaaatcatctggcttaactgggggcttgcggtgggtacgggccggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggttcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggtttccctcctttgtgggggccggttcacaggtggtgcatggttgtcgtcagctcgtgtcgtgagatgttgggttaagtcccgcaacgagcgcaacccctgtcccgtgttgccagcacgttgtggtggggactcgcgggagactgccggggtcaactcggaggagggtggggatgacgtcaaatcatcatgccccttatgtcttgggcttcacgcatgctacaatggccggtacagagggctgcgatgccgtgaggtggagcgaatcccttaaagccggtctcagttcggatcggtgtctgcaactcgacaccgtgaagttggagtcgctagtaatcgcagatcagccaacgctgcggtgaatacgttcctcgggccttgtac

SEQ ID NO: 74 - DNA, 1320 bp, Actinomyces sp.
  HKU31
acggactgctcttcagcttgctggggggtggtgagtggcgaacgggtgagtaacacgtgagtaacctgccctcttctttgggataactgccggaaacggttgctaataccgggtattcactggtctccgcatgggggttggtggaaaggggcctcttttggggtttctggtgggggatgggctcgcggcttatcagcttgttggtggggtgatggcctaccaaggctttgacgggtagccggcctgagagggtgaccggtcacattgggactgagatacggcccagactcctacgggaggcagcagtggggaattttgcacaatgggcgcaagcctgatgcagcgacgccgcgtgagggatggaggccttcgggttgtaaacctctttcgctcatggtcaagccgcaactgtggttgtggtgagggtagtgggtaaagaagcgccggctaactacgtgccagcagccgcggtaatacgtagggcgcgagcgttgtccggaattattgggcgtaaagggcttgtaggcggtttgtcgcgtctgccgtgaaattccctggcttaactgggggcgtgcggtgggtacgggcaggcttgagtgcggtaggggagactggaattcctggtgtagcggtggaatgcgcagatatcaggaggaacaccggtggcgaaggcgggtctctgggccgttactgacgctgaggagcgaaagcatggggagcgaacaggattagataccctggtagtccatgctgtaaacgttgggcactaggtgtggggaccgtccttggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcaccgcgacactgcagagatgtggtggccttcggggtggtgtgcaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggtcggtacagagggttgcgataccgyraggtggagcgaatcccttaaagccggtctcagttcggattggggtctgcaactcgaccccatgaaggtggagtcgctagtaatcgcagatcagcaacgctgcggtgaatacg

SEQ ID NO: 75 - DNA, 1265 bp, Actinomyces sp.
  ICM34
acgaacgctggcggcgtgcttaacacatgcaagtcgaacgagtggcgaacgggtgagtaacacgtgagtaacctgccctcttctttgggataacgcccggaaacgggtgctaatactggatattgaaagctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatggaggccttcgggttgtaaacctctttcgctcatggtcatgagggtagtgggtaaagaagcgccggctaactacgtgccagcagccgcggtaatacgtagggcgcgagcgttgtccggaattattgggcgtaaagggcttgtaggcggttggtcgcgtctgccgtgaaattctctggcttaactgggggcgtgcggtgggtacgggctgacttgagtgcggtaggggagactggaactcctggtgtagcggtggaatgcgcagatatcaggaagaacaccggtggcgaaggcgggtctctgggccgactgacgctgaggagcgaaagcgtggggagcgaacaggattagataccctggtagtccacgctgtaaacgttgggcactaggtgtgggggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgtgcaggtggtgcatggttgtcgtcagctcgtgtcgtgagatgttgggttaagtcccgcaacgagcgcaacccttgccctatgttgccagcacgtggggactcgtgggggactgccggggttaactcggaggaaggtggggatgacgtcaaatcatcatgccccttatgtcttgggcttcacgcatgctacaatggttggcagagggttgcgatactgtgaggtggagcgaatcccttccagtctcagttcggatggggtctgcaactcgaccccagaaggtggagtcgctagtaatcgcagatcagcaacgctgcggtgaatacgttctcgggccttgtacacaccgcccgtcacgtcacgaaagttggtaacacccgaagcccatgcctaggg

SEQ ID NO: 76 - DNA, 1331 bp, Actinomyces sp.
  ICM41
tcttctttgggataacgcccggaaacgggtgctaatactggatattcactgatcttcgcatgggggttggtggaaaggttttttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatggaggccttcgggttgtaaacctctttcgctcatggtcaagccgcaacttagggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggctgacttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgatatcgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccgcgtttgcggggggagtggt

SEQ ID NO: 77 - DNA, 1281 bp, Actinomyces sp.
  ICM47
gctcaggacgaacgctggcggcgtgcttaacacatgcaagtcgaacgagtggcgaacgggtgagtaacacgtgagtaacctgccctcttctttgggataacgcccggaaacgggtgctaatactggatattgaaagctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatggaggccttcgggttgtaaacctctttcgctcatggtcatgagggtagtgggtaaagaagcgccggctaactacgtgccagcagccgcggtaatacgtagggcgcgagcgttgtccggaattattgggcgtaaagggcttgtaggcggttggtcgcgtctgccgtgaaattctctggcttaactgggggcgtgcggtgggtacgggctgacttgagtgcggtaggggagactggaactcctggtgtagcggtggaatgcgcagatatcaggaagaacaccggtggcgaaggcgggtctctgggccgactgacgctgaggagcgaaagcgtggggagcgaacaggattagataccctggtagtccacgctgtaaacgttgggcactaggtgtgggggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgtgcaggtggtgcatggttgtcgtcagctcgtgtcgtgagatgttgggttaagtcccgcaacgagcgcaacccttgccctatgttgccagcacgtggggactcgtgggggactgccggggttaactcggaggaaggtggggatgacgtcaaatcatcatgccccttatgtcttgggcttcacgcatgctacaatggttggcagagggttgcgatactgtgaggtggagcgaatcccttccagtctcagttcggatggggtctgcaactcgaccccagaaggtggagtcgctagtaatcgcagatcagcaacgctgcggtgaatacgttctcgggccttgtacacaccgcccgtcacgtcacgaaagttggtaacacccgaagcccatgcctagggagtggtcga

SEQ ID NO: 78 - DNA, 1260 bp, Actinomyces sp.
  ICM54
gaacgctggcggcgtgcttaacacatgcaagtcgaacgagtggcgaacgggtgagtaacacgtgagtaacctgcccccttctttgggataacgcccggaaacgggtgctaatactggatattgaaagctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatgacggccttcgggttgtaaacctctttcgctcatggtcatgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggctgacttgagtgcggtaggggagactggaactcctggtgtagcggtggaatgcgcagatatcaggaagaacaccggtggcgaaggcgggtctctgggccgactgacgctgaggagcgaaagcgtggggagcgaacaggattagataccctggtagtccacgctgtaaacgttgggcactaggtgtgggggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgtgcaggtggtgcatggttgtcgtcagctcgtgtcgtgagatgttgggttaagtcccgcaacgagcgcaacccttgccctatgttgccagcacgtggggactcgtgggggactgccggggttaactcggaggaaggtggggatgacgtcaaatcatcatgccccttatgtcttgggcttcacgcatgctacaatggttggcagagggttgcgatactgtgaggtggagcgaatcccttccagtctcagttcggatggggtctgcaactcgaccccagaaggtggagtcgctagtaatcgcagatcagcaacgctgcggtgaatacgttctcgggccttgtacacaccgcccgtcacgtcacgaaagttggtaacacccgaagcccatgccta

SEQ ID NO: 79 - DNA, 1484 bp, Actinomyces sp.
  M2231/94/1
  modified_base (770)..(770): a, c, t, g, unknown or other
  modified_base (772)..(772): a, c, t, g, unknown or other
  modified_base (878)..(878): a, c, t, g, unknown or other
  modified_base (939)..(939): a, c, t, g, unknown or other
ttgatcctggctcaggacgaacgctgacggcgtgcttaacacatgcaagtcgaacggtgaagcccctttttttggggtggatgagtggcgaacgggtgagtaacacgtgagtaacctgcccctgactcctggataactgcttgaaagggtggctaatacgggdgtgtcctggcctgggcgcatgtctgggtttggaaagattccatgtttttggttttggttggggatgggctcgcggcctatcagcttgttggtggggtgatggcctaccaaggcgttgacgggtagccggcctgagagggtggacggtcacactgggactgagacacggcccagactcctacgggaggcagcagtggggaatattgcacaatgggcgcaagcctgatgcagcgacgccgcgtgagggatgacggccttcgggttgtaaacctctttcgccagtgaggaaggcctgctcctttttgtgggtgggttgacggtagctggataagaagcgccggctaactacgtgccagcagccgcggtaatacgtagggcgcgagcgttgtccggaattattgggcgtaaagagctcgtaggcggctggtcgcgtctgccgtgaaatcccctggcttaactgggggcgtgcggtgggtacgggccggcttgagtgcggtaggggaggctggaactcctggtgtagcggtggaatgcgcagatatcaggaggaacaccggtggcgaaggcgggtctctgggccgttactgacgctgaggagcgaaagcgtngngagcgaacaggattagataccctggtagtccacgccgtaaacgttgggcactaggtgtggggggtctttccgggtcctccgcgccgtagctaacgcattaagtgcnccgcctggggagtacggccgcaaggctaaaactcaaaggaattgacgggggcccgcacaancggcggagcatgcggattaattcgatgcaacgcgaagaaccttaccaaggcttgacatgtcagcgctggctgcagagatgtggtctcctcacttgtggggcgctgtcacaggtggtgcatggttgtcgtcagctcgtgtcgtgagatgttgggttaagtcccgcaacgagcgcaacccttgtcccgtgttgccagcacgtcgtggtggggactcgcgggagactgccggggtcaactcggaggaaggtggggatgacgtcaaatcatcatgccccttatgtcttgggcttcacgcatgctacaatggccggtacagagggctgcgatgccgtgaggcggagcgaatcccttaaagccggtctcagttcggatcggtgtctgcaactcgacaccgtgaagttggagtcgctagtaatcgcagatcagcaacgctgcggtgaatacgtcctcgggccttgtacacaccgcccgtcacgtcatgaaagctggcaacacccgaagcccgtggccctacggggagcggtcgaaggtggggctggtgattg

SEQ ID NO: 80 - DNA, 1419 bp, Actinomyces sp.
  TeJ5
  modified_base (500)..(500): a, c, t, g, unknown or other
  modified_base (503)..(503): a, c, t, g, unknown or other
gcttacacatgcagtcgaacgatgatgcggcgcttgcgccgttgattagtggcgaacgggtgagtaacacgtgagtaacctgcccccttcttcgggataacggtctgaaagggctgctaataccgggtattcactggtctccgcatgggggctggtggaaagggttttttctggtgggggatgggctcgcggcctatcagcttgttggtggggtgatggcccaccaaggctttgacgggtagccggcctgagagggtgaccggtcacattgggactgagatacggcccagactcctacgggaggcagcagtggggaatattgcacaatgggcgcaagcctgatgcagcgacgccgcgtgagggatggaggccttcgggttgtgaacctctttcgcccgtggtcaagccgcgacgtgggtcgtggtgagggtagtgggtaaagaagcgccggctaactacgtgccagcagccgcggtaatacgtagggcgcgagcgtgtcnganatgggcgtaaagggctgtaggcgctggtcgcgtctgccgtgaaatcctctggctcaactgggagcgtgcggtgggtacgggctggcttgagtgcggtaggggaggctggaactctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggttcccgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccccgggcgcgcggagacgcgcgcgcatttggttgggggtgtgcaggtggtgcatggttgtcgtcagctcgtgtcgtgagatgttgggttaagtcccgcaacgagcgcaacccttgccctatgttgccagcgcgttgtggcggggactcgtgggggactgccggggttaactcggaggaaggtggggatgacgtcaaatcatcatgccccttatgtcttgggcttcacgcatgctacaatggccggtacagagggttgcgatgccgtgaggcggggcgaatcccttaaagccggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacgcccgaagcccatggcccaaccggctcttgctggggggagtggtcgaaggtgg

SEQ ID NO: 81 - DNA, 1443 bp, Actinomyces sp.
  c109
gccccacacatgcaagtggagcgacgaaccggggcttgccccggggcagagccgcgaacgggtgagtaacacgtgggttacctgccccgatgactgggacaacccgtcgaaagacgggctaataccggatgtgccccttgggggaaaggaagcttcggcctccgcatcgggatgggcccgcggcgcattagcttgttggtggggtaatggcttaccaaggcgacgatgcgtagctggtctgagaggacgatcagccacactgggactgagacacggcccagactcctacgggaggcagcagtggggaatcttgcacaatgcgcgaaagcgtgatgcagcaacgccgcgtgcgggaagaaggccctagggttgtaaaccgctttcagttgggacgaagcttcagtcgttaatagcggtttggagtgacggtaccttcagaagaagcgccggctaactacgtgccagcagccgcggtaatacgtagggcgcgagcgttgtccggaatcattgggcgtaaagcgcgtgtaggcggctgagtaagtctgctgtgaaagtccagggctcaaccctggaatgtcggcggatactgctcagctggagtacgggaggggcgagtggaattcctggtgtagcggtggaatgcgcagatatcaggaggaacacctatggcgaaggcagctcgctggaacgttactgacgctgagacgcgaaagcgtggggagcaaacaggattagataccctggtagtccacgctgtaaacgatggatactaggtgtggggggtgtcaactccctccgtgccgaagctaacgcattaagtatcccgcctggggagtacggccgcaaggctaaaactcaaaggaattgacgggggcccgcacaagcagcggagcatgtggtttaattcgacgcaacgcgaagaaccttacctgggcttgacatgttcttgatcggcgtggaaacacgtcttccctcacgggcaagatcacaggtggtgcatggctgtcgtcagctcgtgtcgtgagatgttgggttaagtcccgcaacgagcgcaacccccgtcgtatgttgccagcatttagttggggactcatgcgagactgccggtggcaaaccggaggaaggtggggatgacgtcaagtcatcatgccccttatgtccagggctacacacgtgctacattggcgtatacaaagggtagcgataccgcgaggtggagcgaatctcacaaagtacgtctcggttcggattgcaggctgaaactcgcctgcatgaaggtggagttgctagtaatcgtggatcagcaatgccgcggtgaatacgttcccgggccttgtacacaccgcccgtcacaccacgggagtgagcaacacccgaagccggtggcctaacccgcaagggagggagccgtcgaaggtggggctcgtgactggggtgaagtcg

SEQ ID NO: 82 - DNA, 1547 bp, Actinomyces sp.
  oral clone GU009
gagtttgattctggctcaggacgaacgctggcggcgtgcttaacacatgcaagtcgaacgggcccgcaccttttttgggggcgggttgagtggcgaacgggtgagtatcacgtgagtaacctgccctcctctcctggataaccgcttgaaagggcggctaatacggggtggtccggttggtccgcatgggccggtcgggatagtttcatcttcgggtgtttcggtgggggatgggctcgcggcctatcagcttgttggtggggtgatggcccaccaaggcggtgacgggtagccggcctgagagggtgggcggccacactgggactgagacacggcccagactcctgcgggaggcagcagtggggggtattgcacaatgggcggaagcctgatgcagcgacgtcgcgtgagggatggaggccttcgggttgtgaacctctgtttccggtggtgaaggccccgcccctggtggtggggttgacggtagccgggtatgaagcgccggctaactacgtgccagcagccgcggtaatacgtagggcgcgagcgttgtccggaattattgggcgtaaagggcttgtaggcggccggccgcgtccgtcgtgaaatcctccggctcaaccgggggcttgcggtgggtacgggtcggctggagtgcggcaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgatatcgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccggtttgccggggggagtggtcgaaggtgggattggcgattgggacgaagtcgtaacaaggtagccgtaccggaaggtgcggctggaacacctccttc

SEQ ID NO: 83 - DNA, 1366 bp, Actinomyces sp.
  oral clone GU067
gagtttgatcctggctcaggacgaacgctggcggcgtgcttaacacatgcaagtcgaacgagtggcgaacgggtgagtaacacgtgagtaacctgcccccttcttctggataaccgcatgaaagtgtggctaatacgggatattgaaagtcggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtaaacctctttcgccagtgaagctgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgactgacgctgaggagcgaaagcgtggggagcgaacaggattagataccctggtagtccacgccgtaaacgttgggcactaggtgtgggggcttccgcgccgtagctaacgcattaagtgccccgcccggggagtacggccgcaaggctaaaactcaaaggaattgacgggggcccgcacaagcggcggagcatgcggattaattcgatgcaacgcgaagaaccttaccaaggcttgacatgcacaggtggtgcatggttgtcgtcagctcgtgtcgtgagatgttgggttaagtcccgcaacgagcgcaacccttgtctcgtgttgccagcacgtggggactcgcgggagactgccggggttaactcggaggaaggtggggatgacgtcaaatcatcatgccccttatgtcttgggcttcacgcatgctacaatggccggcagtgggttgcgatgctgtgaggcggagcgaatccctgccggtctcagttcggacggtgtctgcaactcgacaccggaagttggagtcgctagtaatcgcagatcagcaacgctgcggtgaatacgttctcgggccttgtacacaccgcccgtcacgtcatgaaagctggcaacacccgaagcccgtgcctgggagcggtcgaaggtggggctggtgattgggacgaagtcgtaacaaggtagccgtaccggaaggtgcggctggaacacctcctt

SEQ ID NO: 84 - DNA, 1532 bp, Actinomyces sp.
  oral clone IO076
gagtttgattctggctcaggacgaacgctggcggcgtgcttaacacatgcaagtcgaacgatgaagcgctgtctttttggcggtgtggattagtggcgaacgggtgagtaatacgcgggcaacctgcccctctgcttcgggataagctttggaaacggggtctaataccggatgtgcctgtctggtcgcatggctgggcggggaaagatgtttttcggcgggggatgggctcgcggcctatcagcttgttggtggggtgacggcctaccaaggcgtcgacgggtagccggcctgagagggtggtcggccacactgggactgagatacggcccagactcctacgggaggcagcagtgggggatattgcacaatgggcgcaagcctgatgcagcgacgccgcgtgggggatggaggctttcgggttgtaaacccctttcggcgcgggacaaggctccgtttggcggggttgagggtacgcgtcaaagaagcgccggctaactacgtgccagcagccgcggtaatacgtagggcgcgagcgttgtccggaattattgggcgtaaagggctcgtaggcggcttgtcgcgtctgctgtgaaaacgcggggctcaactccgcgcgtgcagtgggtacgggcaggctggagtgcggcaggggtggctggaattcctggtgtagcggtggaatgcgcagatatcaggaagaacaccgatggcgaaggcaggccactgggccgtcactgacgctggggagcgaaagcgtggggagcgaacaggattagataccctggtagtccacgccgtaaacgttgggcactaggtgtggggggccttttccgggtcttccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgacatgtgccggtcggctccggagacgggagcgtcccctttttgtgggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggagggtggggatgacgtcaaatcatcatgccccttatgtcttgggcttcacgcatgctacaatggccggtacagtgggttgcgatgtcgtgaggcggagcgaatccctgaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccttatggggagcggtcgaaggtggggctggtgattgggacgaagtcgtaacaaggtagccgtaccggaaggtgcggctggaacacctcctt

SEQ ID NO: 85 - DNA, 1544 bp, Actinomyces sp.
  oral clone IO077
gagtttgatcctggctcaggacgaacgctggcggcgtgcttaacacatgcaagtcgaacggtgaagggatcagcttgctggttctggatgagtggcgaacgggtgagtaacacgtgagtaacctgcccccttcttctggataaccgcatgaaagtgtggctaatacgggatattctgggtctgtcgcatggcgggtctgggaaagatgcgcctttgggtgtttttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtaaacctctttcgccagtgaagcaggcctgctccttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcgtgcggtgggtacgggccggcttgagtgcggtaggggaggctggaattcctggtgtagcggtggaatgcgcagatatcaggaggaacaccggtggcgaaggcgggtctctgggccgtgtactgacgctgagagcgaaagcgtggggagcgaacaggattagataccctggtagtccatgctgtaaacgttgggcactaggtgtggggggtctttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggtggttcccggagacgggagcgtcccctttttgtgggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggagggtggggatgacgtcaaatcatcatgccccttatgtcttgggcttcacgcatgctacaatggccggtacagtgggttgcgatgtcgtgaggcggagcgaatccctgaaagccggtctcagttcggatcggtgtctgcaactcgacaccgtgaagttggagtcgctagtaatcgcagatcagcaacgctgcggtgaatacgttctcgggccctgtacacaccgcccgtcacgtcatgaaagtcggcaacacccgaagcccgtggccttatggggagcggtcgaaggtggggctggtgattgggacgaagtcgtaacaaggtagccgtaccggaaggtgcggttggatcacctcctt

SEQ ID NO: 86 - DNA, 1362 bp, Actinomyces sp.
  oral clone IP073
gagtttgattctggctcaggacgaacgctggcggcgtgcttaacacatgcaagtcgaacgagtggcgaacgggtgagtaacacgtgagtaacctgccctcttctcttggataactgcttgaaagggcggctaatacgggatgttgaaagttggtgggggatgggctcgcggcttatcagcttgttggtggggtgatggcctaccaaggcggtgacgggtagccggcctgagagggtggacggtcacactgggactgagacacggcccagactcctgcgggaggcagcagtgggggattttgcacaatgggcgcaagcctgatgcagcgacgccgcgtgagggatggaggccttcgggttgtgaacctctgtcgccggtgatgttgacggtagccgggtatgaagtgccggctaactacgtgccagcagccgcggtaatacgtagggcgcgagcgttgtccggaattattgggcgtaaagagctcgtaggcggctggtcgcgtctgtcgtgaaatcctctggcttaactgggggcgtgcggtgggtacgggccggcttgagtgcggtaggggaggctggaattcctggtgtagcggtggaatgcgcagatatcaggaggaacaccggtggcgaaggcgggtctctgggccgactgacgctgaggagcgaaagcgtggggagcgaacaggattagataccctggtagtccatgctgtaaacgttgggcactaggtgtgggggcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcacaggtggtgcatggttgtcgtcagctcgtgtcgtgagatgttgggttaagtcccgcaacgagcgcaacccttgtctcgtgttgccagcacgtggggactcgcgggagactgccggggtcaactcggaggagggtggggatgacgtcaaatcatcatgccccttatgtcttgggcttcacgcatgctacaatggccggcagagggctgcgataccgtgaggtggagcgaatcccttccggtctcagttcggacggtgtctgcaactcgacaccggaagttggagtcgctagtaatcgcagatcagcaacgctgcggtgaatacgttctcgggccttgtacacaccgcccgtcacgtcatgaaagtcggcaacacccgaagcccgtgcgagcggtcgaaggtggggctggtgattgggacgaagtcgtaacaaggtagccgtaccggaaggtgcggctggatcacctcctt

SEQ ID NO: 87 - DNA, 1543 bp, Actinomyces sp.
  oral clone IP081
gagtttgattctggctcaggacgaacgctggcggcgtgcttaacacatgcaagtcgaacgggcccgctctcttttttgggggtgggttgagtggcgaacgggtgagtatcacgtgagtaacctgccccctgctcctggataactgcttgaaagggcggctaatacggggtgtgccggctggtccgcatgggcctggtcgggatagtttcatcttcgggtgtttcggtgggggatgggctcgcggcctatcagcttgttggtggggtgatggcccaccaaggcggtgacgggtagccggcctgagagggtgggcggccacactgggactgagacacggcccagactcctgcgggaggcagcagtggggggtattgcacaatgggcggaagcctgatgcagcgacgtcgcgtgagggatggaggccttcgggttgtgaacctctttctccggtggtgaaggccctgtccgttgcggcggggttgacggtagccgggtatgaagcgccggctaactacgtgccagcagccgcggtaatacgtagggcgcgagcgttgtccggaattattgggcgtgaagggcttgtaggcggccggtcgcgtccgccgtgaaattctccggctcaaccgggggcttgcggtgggtacgggccggctggagtgcggtaggggaggctggaactcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggagggtggggatgacgtcaaatcatcatgccccttatgtcttgggcttcacgcatgctacaatggccggtacagtgggttgcgatgtcgtgaggcggagcgaatccctgaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccttatggggagcggtcgaaggtggggctggtgattgggacgaagtcgtaacaaggtagccgtaccggaaggtgcggctggatcacctcctt

SEQ ID NO: 88 - DNA, 1366 bp, Actinomyces sp.
  oral clone JA063
gagtttgatcctggctcaggacgaacgctggcggcgtgcttaacacatgcaagtcgaacgagtggcgaacgggtgagtaacacgtgagtaacctgcccccttcttctggataaccgcatgaaagtgtggctaatacgggatattgaaagttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagctgacggtagctggataagaagcgccggctaactacgtgccagcagccgtggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggaggctggaactcctggtgtagcggtggaatgcgcagatatcaggaagaacaccggtggcgaaggcgggtctctgggccgactgacgctgaggagcgaaagcgtggggagcgaacaggattagataccctggtagtccacgccgtaaacgttgggcactaggtgtgggggtttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcacaggtggtgcatggttgtcgtcagctcgtgtcgtgagatgttgggttaagtcccgcaacgagcgcaacccttgtctcgtgttgccagcacgtggggactcgcgggagactgccggggtcaactcggaggaaggtggggatgacgtcaaatcatcatgccccttatgtcttgggcttcacgcatgctacaatggccggcagagggctgcgataccgtgaggtggagcgaatcccttccggtctcagttcggacggtgtctgcaactcgacaccggaagttggagtcgctagtaatcgcagatcagcaacgctgcggtgaatacgttctcgggccttgtacacaccgcccgtcacgtcatgaaagtcggcaacacccgaagcccgtgcctgggagcggtcgaaggtggggctggtgattgggacgaagtcgtaacaaggtagccgtaccggaaggtgcggctggaacacctcctt

SEQ ID NO: 89 - DNA, 1563 bp, Actinomyces sp.
  oral taxon 170
tttgtttggagagtttgatcctggctcaggacgaacgctggcggcgtgcttaacacatgcaagtcgaacggtgaagcgccttcctttgtggtgggtgtggatgagtggcgaacgggtgagtaacacgtgagtaacctgcccccttcttctggataaccgcatgaaagtgtggctaatacgggatattctgtgcctgctgcatggtgggtgtgggaaagattgcgcctttgggtgtttttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgtccctgtgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtttgcttcggagacggggtttcctcctttgtgggggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctatggggagcggtcgaaggtggggctggtgattgggacgaagtcgtaacaaggtagccgtaccggaaggtgcggctggatcacctcctttct

SEQ ID NO: 90 - DNA, 1561 bp, Actinomyces sp.
  oral taxon 171
tttgtttggagagtttgatcctggctcaggacgaacgctggcggcgtgcttaacacatgcaagtcgaacggtgaaggggcctgcttttgtgggtcctggatgagtggcgaacgggtgagtaacacgtgagtaacctgcccccttcttctggataaccgcatgaaagtgtggctaatacgggatattctgtgcctgctgcatggtgggtgtgggaaagattgtgcctttgggtgttttcggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgtcccttttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtagccgtaccggaaggtgcggctggatcacctcctttct

SEQ ID NO: 91 - DNA, 1551 bp, Actinomyces sp.
  oral taxon 178
tttgttcggagagtttgatcctggctcaggacgaacgctggcggcgtgcttaacacatgcaagtcgaacgcgcctgtcctctggttttccggggggtgggtgagtggcgaacgggtgagtaacacgtgagtaacctgcccccttcttcgggataacggtctgaaagggctgctaataccgggtattcactggtctccgcatggggtctggtggaaaggttttttctggtgggggatgggctcgcggcctatcagcttgttggtggggtgatggcccaccaaggctttgacgggtagccggcctgagagggtgaccggtcacattgggactgagatacggcccagactcctacgggaggcagcagtggggaatattgcacaatgggcgcaagcctgatgcagcgacgccgcgtgagggatggaggccttcgggttgtgaacctctttcgcccgtggtcaagccgcgacgtgggtcgtggtgagggtagtgggtaaagaagcgccggctaactacgtgccagcagccgcggtaatacgtagggcgcgagcgttgtccggaattattgggcgtaaagggcttgtaggcggctggtcgcgtctgccgtgaaatcctctggctcaactgggggcgtgcggtgggtacgggctggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggttcccgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccccgggcgcgcggagacgcgcgcgcatttggttgggggtgtgcaggtggtgcatggttgtcgtcagctcgtgtcgtgagatgttgggttaagtcccgcaacgagcgcaacccttgccctatgttgccagcgcgttgtggcggggactcgtgggggactgccggggttaactcggaggaaggtggggatgacgtcaaatcatcatgccccttatgtcttgggcttcacgcatgctacaatggccggtacagagggttgcgatgccgtgaggcggggcgaatcccttaaagccggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacgcccgaagcccatggcccaaccggctcttgctggggggagtggtcgaaggtgggatcggcgattgggacgaagtcgtaacaaggtagccgtaccggaaggtgcggctggatcacctcctttct

SEQ ID NO: 92 - DNA, 1545 bp, Actinomyces sp.
  oral taxon 180
tttgttcggagagtttgatcctggctcaggacgaacgctggcggcgtgcttaacacatgcaagtcgaacgctgaagctcagcttttgttgggtggatgagtggcgaacgggtgagtaacacgtgagtaacctgcccccttctttgggataacgcccggaaacgggtgctaatactggatattcactggtcttcgcatgggggttggtggaaagggtttttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgcaagcctgatgcagcgacgccgcgtgagggatggaggccttcgggttgtgaacctctttcgctcatggtcaagccgcaacaatggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggctgacttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgatactgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccgcttttgcggggggagtggtcgaaggtgggattggcgattgggacgaagtcgtaacaaggtagccgtaccggaaggtgcggctggatcacctcctttct

SEQ ID NO: 93 - DNA, 1548 bp, Actinomyces sp.
  oral taxon 848
tttttgtggagagtttgatcctggctcaggacgaacgctggcggcgtgcttaacacatgcaagtcgaacgatgaagcgctgtctttttgatggtgtggattagtggcgaacgggtgagtaatacgcgggcaacctgcccctctgcttcgggataagctttggaaacggggtctaataccggatgtgcctgtctggtcgcatggctgggcggggaaagatgtttttcggcgggggatgggctcgcggcctatcagcttgttggtggggtgacggcctaccaaggcgtcgacgggtagccggcctgagagggtggtcggccacactgggactgagatacggcccagactcctacgggaggcagcagtgggggatattgcacaatgggcgcaagcctgatgcagcgacgccgcgtgggggatggaggctttcgggttgtaaacccctttcggcgcgggacaaggctccgtttggcggggttgagggtacgcgtcaaagaagcgccggctaactacgtgccagcagccgcggtaatacgtagggcgcgagcgttgtccggaattattgggcgtaaagggctcgtaggcggcttgtcgcgtctgctgtgaaaacgcggggctcaactccgcgcgtgcagtgggtacgggcaggctggagtgcggcaggggtggctggaattcctggtgtagcggtggaatgcgcagatatcaggaagaacaccgatggcgaaggcaggccactgggccgtcactgacgctgaggagcgaaagcgtggggagcgaacaggattagataccctggtagtccacgctgtaaacgttgggaactaggtgtggggtctgttccacggattctgcgccggagctaacgcgttaagttccccgcctggggagtacggccgcaaggctaaaactcaaaggaattgacgggggcccgcacaagcggcggagcatgcggattaattcgatgcaacgcgaagaaccttaccaaggcttgacatgtgccgggagggcgcggagacgcgtctgccttcgggccggttcacaggtggtgcatggttgtcgtcagctcgtgtcgtgagatgttgggttaagtcccgcaacgagcgcaacccttgtcccgtgttgccagcgcgttgtggcggggactcacgggggactgccggggtcaactcggaggaaggtggggacgacgtcaaatcatcatgccccttatgccttgggcttcacgcatgctacaatggccggtacagagggtggcgatgccgtgaggcggagcgaatcttgtaaagccggtctcagttcggatcggggtctgcaactcgggcccgtgaagtcggagtcgctagtaatcgcagatcagcaacgctgcggtgaatacgttctcgggccttgtacacaccgcccgtcacgtcacgaaagtcggcgacgcccgaagcccgtggctctgcttgtgcggggagcggtcgaaggcggggttggcgattgggacgaagtcgtaacaaggtagccgtaccggaaggtgcggctggatcacctcctttctagggag

SEQ ID NO: 94 - DNA, 1505 bp, Actinomyces sp.
  oral taxon C55
agagtttgatcctggctcaggacgaacgctggcggcgtgcttaacacatgcaagtcggacggactgcttgggggcttgctcctgggtggtgagtggcgaacgggtgagtaacacgtgagtaacctgccctcttcttcgggataacggttggaaacggctgctaataccgggtattcactggtcctcgcatgggggttggtggaaaggggtttttctggtgggggatgggctcgcggcttatcagcttgttggtggggtgatggcttaccaaggctttgacgggtagccggcctgagagggtgaccggtcacattgggactgagatacggcccagactcctacgggaggcagcagtggggaattttgcacaatgggcgcaagcctgatgcagcgacgccgcgtgagggatggaggccttcgggttgtgaacctctttcgctcatggtcaagccgcagttttgtctgtggtgagggtagtgggtaaagaagcgccggctaactacgtgccagcagccgcggtaatacgtagggcgcgagcgttgtccggaattattgggcgtaaagggcttgtaggcggcttgtcgcgtctgccgtgaaatcctctggcttaactgggggcgtgcggtgggtacgggctggcttgagtgcggtaggggagactggaattcctggtgtagcggtggaatgcgcagatatcaggaggaacaccggtggcgaaggcgggtctctgggccgttactgacgctgaggaacgaaagcatggggagcgaacaggattagataccctggtagtccatgctgtaaacgttgggcactaggtgtgggggccgtccttggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcaccgcgacactgcagagatgtggtggccttcggggtggtgtgcaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggcaggtacagagggttgcgatgccgtgaggtggagcgaatcccttaaagcttgtctcagttcggattggggtctgcaactcgaccccatgaaggtggagtcgctagtaatcgcagatcagcaacgctggggtgaatacgttctcgggccttgtacacaccgcccgtcacgtcacgaaagttggtaacacccgaagcccatggcccaaccatttcggtggggggagtggtcgaaggtgggattggcgattgggacgaagtcgtaacaaggtagccgt

SEQ ID NO: 95 - DNA, 1543 bp, Actinomyces urogenitalis
tttgtttggagagtttgatcctggctcaggacgaacgctggcggcgtgcttaacacatgcaagtcgaacggtgaagctccagcttgctggggtggatgagtggcgaacgggtgagtaacacgtgagtaacctgcccccttcttctggataactgcttgaaagggtagctaatacgggatattctggcctgctcgcatgggtgggtttggaaaggttttttctggtgggggatgggctcgcggcctatcagcttgttggtggggtgatggcctaccaaggcggtgacgggtagccggcctgagagggtggacggccacactgggactgagacacggcccagactcctacgggaggcagcagtggggaatattgcacaatgggcgcaagcctgatgcagcgacgccgcgtgagggatggaggccttcgggttgtaaacctctttcgccagtgaagcaggccatcttctttgtggggtggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcccctggcttaactgggggcttgcggtgggtacgggccggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtgggggctctttccggggtttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgagcgtctgcctcagagatggggtttcctccttgtggggcgctttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggttgcgatgtcgtgaggcggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccttacggggagcggtcgaaggtggggctggtgattgggacgaagtcgtaacaaggtagccgtaccggaaggtgcggctggatcacctcctttct

SEQ ID NO: 96 - DNA, 1556 bp, Actinomyces viscosus
tttgtttggagagtttgatcctggctcaggacgaacgctggcggcgtgcttaacacatgcaagtcgaacggtgaagggatcagcttgctggttctggatgagtggcgaacgggtgagtaacacgtgagtaacctgcccccttcttctggataaccgcatgaaagtgtggctaatacgggatattctgggtctgtcgcatggcgggcctgggaaagatgcgcctttgggtgtttttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtaaacctctttcgccagtgaagcaggcctgtcccttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtagccgtaccggaaggtgcggctggatcacctcctttct

SEQ ID NO: 97 - DNA, 1331 bp, Adlercreutzia equolifaciens
gagtttgatcctggctcaggatgaacgctggcggcgtgcttaacacatgcaagtcgaacgagtggcgaacgggtgagtaacacgtgaccaacctgccccgcgctccgggacaaccgctggaaacggcggctaataccggatgctgaaagcggcgcgggatggggtcgcggcccattaggtagacggcggggtaacggcccaccgtgcccgcgatgggtagccggactgagaggtcgaccggccacattgggactgagatacggcccagactcctacgggaggcagcagtggggaattttgcgcaatgggggcaaccctgacgcagcaacgccgcgtgcgggacgaaggccttcgggttgtaaaccgctttcagcagggaagaagacggtacctgcagaagaagctccggctaactacgtgccagcagccgcggtaatacgtagggggcgagcgttatccggattcattgggcgtaaagcgcgcgtaggcggccgcctaagcggaacctctaatcccggggctcaacctcgggccgggttccggactgggcggctcgagtgcggtagaggcaggcggaattcccggtgtagcggtggaatgcgcagatatcgggaagaacaccgatggcgaaggcagcctgctgggccgactgacgctgaggcgcgaaagctgggggagcgaacaggattagataccctggtagtcccagccgtaaacgatggacgctaggtgtgggggcccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgcgcaggtggtgcatggctgtcgtcagctcgtgtcgtgagatgttgggttaagtcccgcaacgagcgcaacccccgtcccgtgttgccagcatggggactcgcgggagactgccggcgtcaagccggaggaaggtggggacgacgtcaagtcatcatgccccttatgccctgggctgcacacgtgctacaatggccggcagagggttgccaccccgcgagggggagcggatcccggccggtcccagttcggacgcaggctgcaacccgcctgcggaagtcggagttgctagtaatcgcggatcagcatgccgcggtgaatacgttcccgggccttgtacacaccgcccgtcacaccacccgagtcgtctgcacccgaagccgccgccgacggaggcgtcgaaggtgtggagggtaaggggggtgaagtcgtaacaaggtaacc

SEQ ID NO: 98 - DNA, 1488 bp, Aerococcus sanguinicola
ctcaggacgaacgctggcggcatgcctaatacatgcaagtcgagcgaaccgacgaagtgcttgcacttctgacgttagcggcggacgggtgagtaacacgtaaggaacctacctatgagcgggggacaacatccggaaacgggtgctaataccgcatagtaatttgtcaggcatctgacaaattggaaagacggcttttgctgtcactcatagatggtcttgcggtgcattagctagttggtgggataaaagcttaccaaggccatgatgcatagccgacctgagagggtaatcggccacactgggactgagacacggcccagactcctacgggaggcagcagtagggaatcttccgcaatgggcgcaagcctgacggagcaatgccgcgtgagtgaagaaggttttcggatcgtaaaactctgttgtaagagaagaacaaattgtagagtaactgctacagtcttgacggtatcttaccagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtgcagaagaggaaagtggaactccatgtgtagcggtggaatgcgtagatatatggaagaacaccagtggcgaaggcgactttctggtctgtaactgacactgaggctcgaaagcgtgggtagcaaacaggattagataccctggtagtccacgccgtaaacgatgagtgctaggtgttggagggtttccgcccttcagtgccgcagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccagcatttagttgggcactctagcgagactgccggtgacaaaccggaggaaggcggggatgacgtcaaatcatcatgccccttatgacttgggctacacacgtgctacaatggatggtacaacgggctgcgaactcgcgagagtcagcgaatcccttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaaccttttggagccagccgccgaaggtgggacagatgattggggtgaagtcgtaaca

SEQ ID NO: 99 - DNA, 1546 bp, Aerococcus urinae
atgagagtttgatcctggctcaggacgaacgctggcggcgtgcctaatacatgcaagtcgagcgaaccgaagaagtgcttgcacttctgacgttagcggcggacgggtgagtaacacgtaaggaacctaccgataagcgggggacaacatccggaaacgggtgctaataccgcataggaaacaccacctcatggtggtgtttggaaagacggctttgctgtcacttatcgatggccttgcggtgcattagctcgttggtggggtaacggcctaccaaggcaatgatgcatagccgacctgagagggtaatcggccacattgggactgagacacggcccaaactcctacgggaggcagcagtagggaatcttccgcaatgggcgcaagcctgacggagcaacgccgcgtgagtgaagaaggttttcggatcgtaaagctctgttgtaagagaagaacaaattggagagtaactgctccagtcttgacggtatcttaccagaaagccacggctaactacgtgccagcagccgcggtaatacgtaggtggcaagcgttgtccggatttattgggcgtaaagggggcgcaggcggtttcttaagtctgatgtgaaagcccacggcttaaccgtggaagtgcattggaaactggggaacttgagtacagaagaggaaagtggaactccatgtgtagcggtggaatgcgtagatatatggaagaacaccagtggcgaaggcgactttctggtctgtcactgacgctgaggcccgaaagcgtgggtagcaaacaggattagataccctggtagtccacgccgtaaacgatgagtgctaggtgttggagggtttccacccttcagtgccggagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccagcattgagttgggcactctagcgagactgccggtgacaaaccggaggaaggcggggatgacgtcaaatcatcatgccccttatgacttgggctacacacgtgctacaatggatggtacaacgagcagcgaccttgtgaaagcaagcgaatctcttaaagccattctcagttcggattgtagtctgcaactcgactacatgaagccggaatcgctagtaatcgcggatcagcacgccgcggtgaatacgttcccgggtcttgtacacaccgcccgtcacaccacgagagtttgtaacacctgaagtcggtgaggtaacctttggagccagccgccgaaggtgggacagatgattggggtgaagtcgtaacaaggtagccgtaggtgaacctgcggctggatcacctcctttct

SEQ ID NO: 100 - DNA, 1419 bp, Aerococcus urinaeequi
  modified_base (1092)..(1092): a, c, t, g, unknown or other
acatgcaagtcgagcgaacagatgaagtgcttgcacttctgacgttagcggcgaacgggtgagtaacacgtaaggaatctacctataagcgggggataacattcggaaacgggtgctaataccgcataatatcttcttccgcatggaaggagattgaaagacggctctgctgtcacttatagatgaccttgcggtgcattagttagttggtggggtaacggcctaccaagacgatgatgcatagccgacctgagagggtgatcggccacattgggactgagacacggcccaaactcctacgggaggcagcagtagggaatcttccgcaatgggcgaaagcctgacggagcaatgccgcgtgagtgaagaaggccttcgggtcgtaaaactctgttataagagaagaacaaattgtagagtaactgctacagtcttgacggtatcttatcagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtacagaagaggaatgtggaactccatgtgtagcggtggaatgcgtagatatatggaagaacaccagtggcgaaggcgacattctggtctgttactgacactgaggctcgaaagcgtggggagcaaacaggattagataccctggtagtccacgccgtaaacgatgagtgctaggtgttggagggtttccgcccttcagtgccgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccaccctagagatagggctttcccttcggggacaaagtgacaggtggtgcatggttgtcgtcagctcgtgtcgtgagatgttgggttaagtcccgcaacgagcgcaacccctattattagttgccagcattnagttgggcactctaatgagactgccggtgacaaaccggaggaaggtggggatgacgtcaaatcagcatgccccttatgacttgggctacacacgtgctacaatggatggtacaacgagtcgcaaacccgcgagggcaagcaaatctcttaaagccattctcagttcggattgcaggctgcaactcgcctgcatgaagccggaatcgctagtaatcgtggatcagcacgccacggtgaatacgttcccgggtcttgtacacaccgcccgtcacaccacgagagtttgtaacacccgaagtcggtgaggtaacctttatggagccagcc

SEQ ID NO: 101 - DNA, 1548 bp, Aerococcus viridans
atgagagtttgatcctggctcaggacgaacgctggcggcatgcctaatacatgcaagtcgagcgaacagatgaagtgcttgcacttctgacgttagcggcgaacgggtgagtaacacgtaaggaatctacctataagcgggggataacattcggaaacgggtgctaataccgcataatattttcttccgcatggaagaagattgaaagacggctctgctgtcacttatagatgaccttgcggtgcattagttagttggtggggtaatggcctaccaagacgatgatgcatagccgacctgagagggtgatcggccacattgggactgagacacggcccaaactcctacgggaggcagcagtagggaatcttccgcaatgggcgaaagcctgacggagcaatgccgcgtgagtgaagaaggccttcgggtcgtaaaactctgttataagagaagaacaaattgtagagtaactgctacagtcttgacggtatcttatcagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtacagaagaggaatgtggaactccatgtgtagcggtggaatgcgtagatatatggaagaacaccagtggcgaaggcgacattctggtctgttactgacactgaggctcgaaagcgtggggagcaaacaggattagataccctggtagtccacgccgtaaacgatgagtgctaggtgttggagggtttccgcccttcagtgccgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccaccctagagatagggctttcccttcggggacaaagtgacaggtggtgcatggttgtcgtcagctcgtgtcgtgagatgttgggttaagtcccgcaacgagcgcaacccctattattagttgccagcatttagttgggcactctaatgagactgccggtgacaaaccggaggaaggtggggatgacgtcaaatcagcatgccccttatgacttgggctacacacgtgctacaatggatggtacaacgagtcgcaaacccgcgagggcaagcaaatctcttaaagccattctcagttcggattgcaggctgcaactcgcctgcatgaagccggaatcgctagtaatcgtggatcagcacgccacggtgaatacgttcccgggtcttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttct

SEQ ID NO: 102 - DNA, 1357 bp, Aeromicrobium marinum
aagtygagcggtaaggctccttcgggagtacacgagcggcgaacgggtgagtaacacgtgagcaatctgcccttctcttcggaataaccattggaaacgatggctaatgccgaatacgacctcggatcacatgttctgaggtggaaagctccggcggagaaggatgagctcgcggcctatcagctagttggtgaggtaacggctcaccaaggcattgacgggtagccggcctgagagggtgaccggccacactgggactgagacacggcccagactcctacgggaggcagcagtggggaatattggacaatgggcgaaaccttgatccagcaacgccgcgtgagggatgacggccttcgggttgtaaacctctttcagcggggacgaagcgaaagtgacggtacccgcagaagaaggacckgccaactacgtgccagcagccgcggtaatacgtagggtccgagcgttgtccggaattattgggcgtaaagggctcgtaggcggtttgtcgcgtcgggagtgaaaactcagggctcaaccctgagcgtgcttccgatacgggcagactagaggtatgcaggggagaacggaattcctggtgtagcggtggaatgcgcagatatcaggaggaacaccggtggcgaaggcggttctctgggcattacctgacgctgaggagcgaaagcatggggagcgaacaggattagataccctggtagtccatgccgtaaacgttgggcgctaggtgtggggaccttccacggtctccgtgccgcagctaacgcattaagcgccccgcctggggagtacggccgcaaggctaaaactcaaaggaattgacgggggcccgcacaagcggcggagcatgctgattaattcgatgcaacgcgaagaaccttacctgggtttgacatataccggaaagctgcagagatgtagccccccttgtggtcggtatacaggtggtgcatggctgtcgtcagctcgtgtcgtgagatgttgggttaagtcccgcaacgagcgcaaccctcgttctatgttgccagcacgtaatggtggggactcataggagactgccggggtcaactcggaggaaggtggggatgacgtcaagtcttcatgccccttatgtccagggcttcaagcatgctacaatggccggtacaaagggctgcgaaaccgcaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcgcaacacccgaagccagtg

SEQ ID NO: 103 - DNA, 1468 bp, Aeromicrobium sp.
  JC14
ctggctcaggacgaacgctggcggcgtgcttaacacatgcaagtcgagcggtaaggccctttcgggggtacacgagcggcgaacgggtgagtaacacgtgagcaatctgcccctgtctctgggataaccactggaaacggtggctaataccggatatgacctccttctgcatggttggtggtggaaaagtccgctggacagggatgagctcgcggcctatcagcttgttggtggggtaatggcctaccaaggcgacgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagcagggacgaagcgaaagtgacggtacctgcagaagaaggaccggccaactacgtgccagcagccgcggtaatacgtagggtccgagcgttgtccggaattattgggcgtaaagggctcgtaggcggtttgtcacgtcgggagtgaaaactcagggcttaaccctgagcgtgcttccgatacgggctgactagagggatgcaggggagaacggaattcctggtgtagcggtggaatgcgcagatatcaggaggaacaccggtggcgaaggcggttctctgggcatttcctgacgctgaggagcgaaagcatggggagcgaacaggattagataccctggtagtccatgccgtaaacgttgggcgctaggtgtggggaccttccacggtttccgtgccgcagctaacgcattaagcgccccgcctggggagtacggccgcaaggctaaaactcaaaggaattgacgggggcccgcacaagcggcggagcatgctgattaattcgatgcaacgcgaagaaccttacctgggtttgacatatgccggaaagcgccagagatggtgcccctttttgtcggtatacaggtggtgcatggctgtcgtcagctcgtgtcgtgagatgttgggttaagtcccgcaacgagcgcaaccctcgtcctatgttgccagcacgttatggtggggactcataggagactgccggggtcaactcggaggaaggtggggatgacgtcaagtcatcatgccccttatgtccagggcttcaagcatgctacaatggccggtacaatgggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggcaacacccgaagccggtggcctaacccttgtggagggagccgtcgaaggtggggctggcgattgggacgaagtcgtaacaagtagccgta

SEQ ID NO: 104 - DNA, 1503 bp, Aeromonas allosaccharophila
gagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataacagttggaaacgactgctaataccgcatacgccctacgggggaaagcaggggaccttcgggccttgcgcgattggatgaacccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttggtagcgaataactgccagctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatccctaagagattggggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaa

SEQ ID NO: 105 - DNA, 1490 bp, Aeromonas enteropelogenes
  modified_base (187)..(187): a, c, t, g, unknown or other
  modified_base (197)..(197): a, c, t, g, unknown or other
  modified_base (212)..(212): a, c, t, g, unknown or other
  modified_base (662)..(664): a, c, t, g, unknown or other
  modified_base (677)..(677): a, c, t, g, unknown or other
  modified_base (1009)..(1009): a, c, t, g, unknown or other
  modified_base (1107)..(1107): a, c, t, g, unknown or other
  modified_base (1115)..(1115): a, c, t, g, unknown or other
  modified_base (1329)..(1329): a, c, t, g, unknown or other
agtttgatcatggctcagattgaacgctggcggcaggcctaacacatgcaagtcgagcggcagcgggaaagtagcttgctacttttgccggcgagcggcggacgggtgagtaatgcctgggaaattgcccagtcgagggggataacagttggaaacgactgctaataccgcatacgcctacgggggnaagcaggggnccttcgggccttgcncgattggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggtcagtagctaatatctgctggctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccggctagagtcttgtagaggggnnnagaattccaggtntagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggccgcacaagcggtggagcatgtggtttaattcgatgcaacgcgaagaaccttacctggccttgacatgtctggaatcctgcagagatncgggagtgccttcgggaatcagaacacaggtgctgcatggctgtcgtcagctcgtgtcgtgagatgttgggttaagtcccgcaacgagcgcaaccccngtcctttnttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggattggagtctgcaactcgactccatgaagtcngaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgt

SEQ ID NO: 106 - DNA, 1547 bp, Aeromonas hydrophila
taaattgaagagtttgatcatggctcagattgaacgctggcggcaggcctaacacatgcaagtcgagcggcagcgggaaagtagcttgctacttttgccggcgagcggcggacgggtgagtaatgcctgggaaattgcccagtcgagggggataacagttggaaacgactgctaataccgcatacgccctacgggggaaagcaggggaccttcgggccttgcgcgattggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttgatgcctaatacgtatcaactgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttac

SEQ ID NO: 107 - DNA, 1503 bp, Aeromonas jandaei
gagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataactactggaaacggtagctaataccgcatacgccctacgggggaaagcaggggaccttcgggccttgcgcgattggatgaacccaggtgggattagctagttggtgaggtaacggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggtcagtagctaatatctgctggctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaa

SEQ ID NO: 108 - DNA, 1546 bp, Aeromonas salmonicida
aaattgaagagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataacagttggaaacgactgctaataccgcatacgccctacgggggaaaggaggggaccttcgggcctttcgcgattggatgaacccaggtgggattagctagttggtggggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttggcgcctaatacgtgtcaactgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgtagagatacgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcgaatcagaatgtcgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttac

SEQ ID NO: 109 - DNA, 1503 bp, Aeromonas trota
gagtttgatcatggctcagattgaacgctggcggcaggcctaacacatgcaagtcgagcggcagcgggaaagtagcttgctacttttgccggcgagcggcggacgggtgagtaatgcctgggaaattgcccagtcgagggggataacagttggaaacgactgctaataccgcatacgccctacgggggaaagcaggggaccttcgggccttgcgcgattggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggtcagtagctaatatctgctggctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggattggagtctgcaactcgactccatgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaa

SEQ ID NO: 110 - DNA, 1532 bp, Aeromonas veronii
  modified_base (1495)..(1496): a, c, t, g, unknown or other
  modified_base (1510)..(1510): a, c, t, g, unknown or other
gagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataactactggaaacggtagctaataccgcatacgcctacgggggaaagcaggggaccttcgggccttgcgcgattggatgaacccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttggtagctaataactgccagctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggccgcacaagcggtggagcatgtggtttaattcgatgcaacgcgaagaaccttacctggccttgacatgtctggaatcctgtagagatacgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacnnggtaaccctagggnaacctgcggctggatcacctcc

SEQ ID NO: 111 - DNA, 1420 bp, Afipia sp.
  4
tggctcagagcgaacgctggcggcaggcttaacacatgcaagtcgaacgggcgtagcaatacgtcagtggcagacgggtgagtaacgcgtgggaacgtaccttttggttcggaacaactgagggaaacttcagctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcagaggtgaaagcctggagctcaactccagaactgcctttgatactgaggatcttgagtatgggagaggtgagtggaactgcgagtgtagaggtgaaattcgtagatattcgcaagaacaccagtggcgaaggcggctcactggcccataactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccctcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggttttacctgaagacggtgcgctaaccgcaaggaggcagccggccacggtagggtcagcgactgggggaagt

SEQ ID NO: 112 - DNA, 1540 bp, Aggregatibacter actinomycetemcomitans
aattgaagagtttgatcatggctcagattgaacgctggcggcaggcttaacacatgcaagtcggacggtagcaggtaagtacttgtacttatgctgacgagtggcggacgggtgagtaatgcttgggaatctgtcttatggagggggataacgacgggaaactgtcgctaataccgcgtagaatcgggagatgaaagtgtgggaccttcgggccacatgccataggatgagcccaagtgtgattaggtagttggtggggtaaaggcctaccaagccgacgatcgctagctggtctgagaggatggccagccacaccgggactgagacacggcccggactcctacgggaggcagcagtggggaatattgcgcaatgggggcaaccctgacgcagccatgccgcgtgaatgaagaaggccttcgggttgtaaagttctttcggtgatgaggaaggttggtgtgttaatagcatgccaaattgacgttaaatacagaagaagcaccggctaactccgtgccagcagccgcggtaatacggggggtgcgagcgttaatcggaataactgggcgtaaagggcacgtaggcggacctttaagtgaggtgtgaaatccccgggcttaacctgggaattgcatttcatactgggggtctggagtactttagggaggggtagaattccacgtgtagcggtgaaatgcgtagagatgtggaggaataccgaaggcgaaggcagccccttggggatgtactgacgctgatgtgcgaaagcgtggggagcaaacaggattagataccctggtagtccacgctgtaaacggtgtcgatttggggattggggtttagccctggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccgaagaagaactcagagatgggtttgtgccttagggagctttgagacaggtgctgcatggctgtcgtcagctcgtgttgtgaaatgttgggttaagtcccgcaacgagcgcaacccttatcctttgttgccagcgacttggtcgggaactcaaaggagactgccggtgataaaccggaggaaggtggggatgacgtcaagtcatcatggcccttacgagtagggctacacacgtgctacaatggcgtatacagagggtaaccaaccagcgatggggagtgaatctcagaaagtacgtctaagtccggattggagtctgcaactcgactccatgaagtcggaatcgctagtaatcgcgaatcagaatgttgcggtgaatacgttcccgggccttgtacacaccgcccgtcacaccatgggagtgggttgtaccagaagtagatagcttaaccgagaggggggcgtttaccacggtatgattcatgactggggtgaagtcgtaacaaggtaaccgtaggggaacctgcggttggatcacctccttac

SEQ ID NO: 113 - DNA, 1539 bp, Aggregatibacter aphrophilus
aattgaagagtttgatcatggctcagattgaacgctggcggcaggcttaacacatgcaagtcgaacggtagcaggtaagtacttgtacttatgctgacgagtggcggacgggtgagtaatgcttggggatctggcttatggagggggataacgacgggaaactgtcgctaataccgcgtagaatcgggagatgaaagtgtgggaccttcgggccacatgccataggatgagcccaagtgggattaggtagttggtggggtaatggcctaccaagccgacgatctctagctggtctgagaggatgaccagccacaccgggactgagacacggcccggactcctacgggaggcagcagtggggaatattgcgcaatgggggcaaccctgacgcagccatgccgcgtgaatgaagaaggccttcgggttgtaaagttctttcggtgacgaggaaggttgttgtgttaatagcgcaacaaattgacgttaatcacagaagaagcaccggctaactccgtgccagcagccgcggtaatacggagggtgcgagcgttaatcggaataactgggcgtaaagggcacgcaggcggacttttaagtgaggtgtgaaatccccgggcttaacctgggaattgcatttcagactgggggtctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacggtgtcgatttggggattgtgctttgagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatatgagagtgccttcgggaaccatgagacaggtgctgcatggctgtcgtcagctcgtgttgtgaaatgttgggttaagtcccgcaacgagcgcaacccttatcctttgttgccagcgatttggtcgggaactcaaaggagactgccggtgataaaccggaggaaggtggggatgacgtcaagtcatcatggcccttacgagtagggctacacacgtgctacaatggcgtatacagagggcgacgaagccgcgaggtggagtgaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttcggggggcgtttaccacggtatgattcatgactggggtgaagtcgtaacaaggtaaccgtaggggaacctgcggttggatcacctccttac

SEQ ID NO: 114 - DNA, 1543 bp, Aggregatibacter segnis
ttgaactgaagagtttgatcatggctcagattgaacgctggcggcaggcttaacacatgcaagtcgaacggtaacaggagagagcttgctttcttgctgacgagtggcggacgggtgagtaatgcttgggaatctggcttatggagggggataacgacgggaaactgtcgctaataccgcgtagagtcgagagacgaaagtgcgggaccgcaaggccgcatgccataggatgagcccaagtgggattaggtagttggtggggtaatggcctaccaagccgacgatctctagctggtctgagaggatgaccagccacaccgggactgagacacggcccggactcctacgggaggcagcagtggggaatattgcgcaatgggggcaaccctgacgcagccatgccgcgtgaatgaagaaggccttcgggttgtaaagttctttcggtgacgaggaaggcgtgatgtttaataggcatcacgattgacgttaatcacagaagaagcaccggctaactccgtgccagcagccgcggtaatacggagggtgcgagcgttaatcggaataactgggcgtaaagggcacgcaggcggctatttaagtgaggtgtgaaatccccgggcttaacctgggaattgcatttcagactgggtagctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggccttgagcttggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatatgagagtgccttcgggaaccatgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacagagggcgacgaagccgcgaggtggagtgaatctcacaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttcgggagggcgtttaccacggtatgattcatgactggggtgaagtcgtaacaaggtaaccgtaggggaacctgcggttggatcacctccttac

SEQ ID NO: 115 - DNA, 1492 bp, Agrobacterium radiobacter
ctcaacatgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgtgtccttcgggagaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacccgtagagatatggggtccacttcggtggcgcagagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaag

SEQ ID NO: 116 - DNA, 1437 bp, Agrobacterium tumefaciens
aacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacc

SEQ ID NO: 117 - DNA, 1473 bp, Agrococcus jenensis
gacgaacgctggcggcgtgcttaacacatgcaagtcgaacgatgaaggaggagcttgctcctccggattagtggcgaacgggtgagtaatacgtgagcaatgtgcccttgactctgggataagcgctggaaacggcgtctaataccggatacgacgaccggaggcatctcctggtcgtggaaagaacttcggtcaaggatcagctcacggcctatcagctagttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgaaggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcacgtctgctgtgaaaacccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcaaacaggcttagataccctggtagtccatgccgtaaacgttgggaactagatgtggggaccattccacggtctccgtgtcgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatacgagaacgcactggagacagtgaactctttggacactcgtatacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgaggtcaaatcatcatgccccttatgtcttgggcttcacgcatgctacaatggccggtacaatgggctgcgataccgcaaggtggagcgaatcccaaaaagccggtctcagttcggattgaggtctgcaactcgacctcatgaagtcggagtcgctagtaatcgtagatcagcaacgctacggtgaatacgttcccgggccttgtacacaccgcccgtcaagtcatgaaagtcggtaacacccgaagccagtggcctaaccttttggagggagctgtcgaaggtgggatcggtgattaggactaagtcgtaacaaggtagccgtaccggaa

SEQ ID NO: 118 - DNA, 1368 bp, Akkermansia muciniphila
tcgaacgagagaattgctagcttgctaataattctctagtggcgcacgggtgagtaacacgtgagtaacctgcccccgagagcgggatagccctgggaaactgggattaataccgcatagtatcgaaagattaaagcagcaatgcgcttggggatgggctcgcggcctattagttagttggtgaggtaacggctcaccaaggcgatgacgggtagccggtctgagaggatgtccggccacactggaactgagacacggtccagacacctacgggtggcagcagtcgagaatcattcacaatgggggaaaccctgatggtgcgacgccgcgtgggggaatgaaggtcttcggattgtaaacccctgtcatgtgggagcaaattaaaaagatagtacccaagaggaagagacggctaactctgtgccagcagccgcggtaatacagaggtctcaagcgttgttcggaatcactgggcgtaaagcgtgcgtaggctgtttcgtaagtcgtgtgtgaaaggcgcgggctcaacccgcggacggcacatgatactgcgagactagagtaatggagggggaaccggaattctcggtgtagcagtgaaatgcgtagatatcgagaggaacactcgtggcgaaggcgggttcctggacattaactgacgctgaggcacgaaggccaggggagcgaaagggattagatacccctgtagtcctggcagtaaacggtgcacgcttggtgtgcggggaatcgaccccctgcgtgccggagctaacgcgttaagcgtgccgcctggggagtacggtcgcaagattaaaactcaaagaaattgacggggacccgcacaagcggtggagtatgtggcttaattcgatgcaacgcgaagaaccttacctgggcttgacatgtaatgaacaacatgtgaaagcatgcgactcttcggaggcgttacacaggtgctgcatggcggtcgtcagctcatgtcctgagatgtttggttaagtccagcaacgagcgcaacccctgttgccagttaccagcacgtgaaggtggggactctggcgagactgcccagatcaactgggaggaaggtggggacgacgtcaggtcagtatggcccttatgcccagggctgcacacgtactacaatgcccagtacagagggggccgaagccgcgaggcggaggaaatcctgaaaactgggcccagttcggactgtaggctgcaacccgcctacacgaagccggaatcgctagtaatggcgcatcagctacggcgccgtgaatacgttcccgggtcttgtacacaccgcccgtcacatcatggaagccggtcgcacccgaagtatctgaagccaaccgcaaggaggca

SEQ ID NO: 119 - DNA, 1462 bp, Alcaligenes faecalis
  modified_base (432)..(432): a, c, t, g, unknown or other
  modified_base (446)..(446): a, c, t, g, unknown or other
attgaacgctagcgggatgctttacacatgcaagtcgaacggcagcgcgagagagcttgctctcttggcggcgagtggcggacgggtgagtaatatatcggaacgtgcccagtagcgggggataactactcgaaagagtggctaataccgcatacgccctacgggggaaagggggggatcgcaagacctctcactattggagcggccgatatcggattagctagttggtggggtaaaggctcaccaaggcaacgatccgtagctggtttgagaggacgaccagccacactgggactgagacacggcccagactcctacgggaggcagcagtggggaattttggacaatgggggaaaccctgatccagccatcccgcgtgtatgatgaaggccttcgggttgtaaagtacttttggcagagaagaaaaggtanctcctaatacgagntactgctgacggtatctgcagaataagcaccggctaactacgtgccagcagccgcggtaatacgtagggtgcaagcgttaatcggaattactgggcgtaaagcgtgtgtaggcggttcggaaagaaagatgtgaaatcccagggctcaaccttggaactgcatttttaactgccgagctagagtatgtcagaggggggtagaattccacgtgtagcagtgaaatgcgtagatatgtggaggaataccgatggcgaaggcagccccctgggataatactgacgctcagacacgaaagcgtggggagcaaacaggattagataccctggtagtccacgccctaaacgatgtcaactagctgttggggccgttaggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaaagccgaagagatttggccgtgctcgcaagagaaccggaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtcgggacagagggtcgccaacccgcgagggggagccaatctcagaaacccgatcgtagtccggatcgcagtctgcaactcgactgcgtgaagtcggaatcgctagtaatcgcggatcagaatgtcgcggtgaatacgttcccgggtcttgtacacaccgcccgtcacaccatgggagtgggtttcaccagaagtaggtagcctaaccgtaaggagggcgcttaccacggtgggattcatgactggggtgaag

SEQ ID NO: 120 - DNA, 1499 bp, Alcaligenes sp.
  CO14
gagtttgatcctggctcagattgaacgctagcgggatgctttacacatgcaagtcgaacggcagcgcgagagagcttgctctcttggcggcgagtggcggacgggtgagtaatatatcggaacgtgcccagtagcgggggataactactcgaaagagtggctaataccgcatacgccctacgggggaaagggggggatcgcaagacctctcactattggagcggccgatatcggattagctagttggtggggtaaaggctcaccaaggcaacgatccgtagctggtttgagaggacgaccagccacactgggactgagacacggcccagactcctacgggaggcagcagtggggaattttggacaatgggggaaaccctgatccagccatcccgcgtgtatgatgaaggccttcgggttgtaaagtacttttggcagagaagaaaaggtatctcctaatacgagatactgctgacggtatctgcagaataagcaccggctaactacgtgccagcagccgcggtaatacgtagggtgcaagcgttaatcggaattactgggcgtaaagcgtgtgtaggcggttcggaaagaaagatgtgaaatcccagggctcaaccttggaactgcatttttaactgccgagctagagtatgtcagaaggggggtagaattccacgtgtagcagtgaaatgcgtagatatgtggaggaataccgatggcgaaggcagccccctgggataatactgacgctcagacacgaagcgtggggagcaaacaggattagataccctggtagtccacgccctaaacgatgtcaactagctgttggggccgttaggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaaagccgaagagatttggccgtgctcgcaagagaaccggaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtcgggacagagggtcgccaacccgcgagggggagccaatctcagaaacccgatcgtagtccggatcgcagtctgcaactcgactgcgtgaagtcggaatcgctagtaatcgcggatcagaatgtcgcggtgaatacgttcccgggtcttgtacacaccgcccgtcacaccatgggagtgggtttcaccagaagtaggtagcctaaccgtaaggagggcgcttaccacggtgggattcatgactggggtgaagtcgtaacaaggtagccgt

SEQ ID NO: 121 - DNA, 1404 bp, Alcaligenes sp.
  S3
atgcaagtcgaacggcagcgcgagagagcttgctctcttggcggcgagtggcggacgggtgagtaatatatcggaacgtgcccagtagcgggggataactactcgaaagagtggctaataccgcatacgccctacgggggaaagggggggatcgcaagacctctcactattggagcggccgatatcggattagctagttggtggggtaaaggctcaccaaggcaacgatccgtagctggtttgagaggacgaccagccacactgggactgagacacggcccagactcctacgggaggcagcagtggggaattttggacaatgggggaaaccctgatccagccatcccgcgtgtatgatgaaggccttcgggttgtaaagtacttttggcagagaagaaaaggtacctcctaatacgaggtactgctgacggtatctgcagaataagcaccggctaactacgtgccagcagccgcggtaatacgtagggtgcaagcgttaatcggaattactgggcgtaaagcgtgtgtaggcggttcggaaagaaagatgtgaaatcccagggctcaaccttggaactgcatttttaactgccgagctagagtatgtcagaggggggtagaattccacgtgtagcagtgaaatgcgtagatatgtggaggaataccgatggcgaaggcagccccctgggataatactgacgctcagacacgaaagcgtggggagcaaacaggattagataccctggtagtccacgccctaaacgatgtcaactagctgttggggccgttaggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaaagccgaagagatttggccgtgctcgcaagagaaccggaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtcgggacagagggtcgccaacccgcgagggggagccaatctcagaaacccgatcgtagtccggatcgcagtctgcaactcgactgcgtgaagtcggaatcgctagtaatcgcggatcagaatgtcgcggtgaatacgttcccgggtcttgtacacaccgcccgtcacaccatgggagtgggtttcaccagaagtaggtagcctaaccgtaaggagggcgct

SEQ ID NO: 122 - DNA, 1528 bp, Alicyclobacillus acidocaldarius
agagtttgatcctggctcaggacgaacgctggcggcgtgcctaatacatgcaagtcgagcggacctcttttgaggtcagcggcggacgggtgaggaacacgtgggtaatctgcctttcagaccggaataacgcccggaaacgggcgctaatatgccggatacgcccgcgaggaggcatcttcttgcggggaaaggcccgattgggccgctgagagaggagcccgcggcgcattagctagttggcggggtaacggcccaccaaggcgacgatgcgtagccgacctgagagggtgaccggccacactgggactgagacacggcccagactcctacgggaggcagcagtagggaatcttccgcaatgggcgcaagcctgacggagcaacgccgcgtgagcgaagaaggccttcgggttgtaaagctctgttgctcggggagagcggcatggggagtggaaagccccatgcgagacggtaccgagtgaggaagccccggctaactacgtgccagcagccgcggtaaaacgtagggggcgagcgttgtccggaatcactgggcgtaaagggtgcgtaggcggtcgagcaagtctggagtgaaagtccatggctcaaccatgggatggctctggaaactgcttgacttgagtgctggagaggcaaggggaattccacgtgtagcggtgaaatgcgtagagatgtggaggaataccagtggcgaaggcgccttgctggacagtgactgacgctgaggcacgaaagcgtggggagcaaacaggattagataccctggtagtccacgccgtaaacgatgagtgctaggtgttggggggacacaccccagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacgggtgcagagatgcaccttcccttcggggcagaggagacaggtggtgcatggttgtcgtcagctcgtgtcgtgagatgttgggttcagtcccgcaacgagcgcaacccttgacctgtgttaccagcgcgttgaggcggggactcacaggtgactgccggcgcaagtcggaggaaggcggggatgacgtcaaatcatcatgcccctgatgtcctgggctacacacgtgctacaatgggcggtacaaagggaggcgaagccgcgaggcggagcgaaacccaaaaagccgctcgtagttcggattgcaggctgcaactcgcctgcatgaagccggaattgctagtaatcgcggatcagcatgccgcggtgaatacgttcccgggccttgtacacaccgcccgtcacaccacgagagtcggcaacacccgaagtcggtgaggtaaccccgaaaggggagccagccgccgaaggtggggtcgatgattggggtgaagtcgtaacaaggtagccgtaccggaaggtgcggctggatcacct

SEQ ID NO: 123 - DNA, 1514 bp, Alicyclobacillus acidoterrestris
agagtttgatcctggctcaggacgaacgctggcggcgtgcctaatacatgcaagtcgagcgagcccttcggggctagcggcggacgggtgagtaacacgtgggcaatctgcctttcagactggaataacactcggaaacgggtgctaatgccggataatacacgggtaggcatctacttgtgttgaaagatgcaactgcatcgctgagagaggagcccgcggcgcattagctagttggtgaggtaacggctcaccaaggcgacgatgcgtagccgacctgagagggtgaccggccacactgggactgagacacggcccagactcctacgggaggcagcagtagggaatcttccgcaatgggcgcaagcctgacggagcaacgccgcgtgagcgaagaaggccttcgggttgtaaagctctgttgctcggggagagcgacaaggagagtggaaagctccttgtgagacggtaccgagtgaggaagccccggctaactacgtgccagcagccgcggtaatacgtagggggcaagcgttgtccggaatcactgggcgtaaagcgtgcgtaggcggttgtgtaagtctgaagtgaaagtccaaggctcaaccttgggattgctttggaaactgcatgacttgagtgctggagaggcaaggggaattccacgtgtagcggtgaaatgcgtagatatgtggaggaataccagtggcgaaggcgccttgctggacagtgactgacgctgaggcacgaaagcgtggggagcaaacaggattagataccctggtagtccacgccgtaaacgatgagtgctaggtgttggggggacacaccccagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgaccggtgcagagatgtaccttcccttcggggcagaggagacaggtggtgcatggttgtcgtcagctcgtgtcgtgagatgttgggttaagtcccgcaacgagcgcaacccttgatctgtgttaccagcacgtagaggtggggactcacaggtgactgccggcgtaagtcggaggaaggcggggatgacgtcaaatcatcatgccctttatgtcctgggctacacacgtgctacaatgggcggtacaacgggaagcgaagccgcgaggtggagcaaaacctaaaaagccgttcgtagttcggattgcaggctgcaactcgcctgcatgaagccggaattgctagtaatcgcggatcagcatgccgcggtgaatccgttcccgggccttgtacacaccgcccgtcacaccacgagagtcggcaacacccgaagtcggtgaggtaaccgttatggagccagccgccgaaggtggggttgatgattggggtgaagtcgtaacaaggtagccgtatcggaaggtgcggttgga

SEQ ID NO: 124 - DNA, 1520 bp, Alicyclobacillus contaminans
  modified_base (182)..(182): a, c, t, g, unknown or other
  modified_base (192)..(192): a, c, t, g, unknown or other
  modified_base (476)..(476): a, c, t, g, unknown or other
tagagtttgatcatggctcaggacgaacgctggcggcgtgcctaatacatgcaagtcgagcggacggaagggagcttgctcctggaagtcagcggcggacgggtgagtaacacgtgggtaatctgcctgtcagaccggaataacgcctggaaacgggtgctaatgccggatagtcagtcttngggcatcttnggactgggaaaggcgctaaggcgtcactgacagaggagcccgcggcgcattagctagttggtggggtaaaggcctaccaaggcgacgatgcgtagccgacctgagagggtgaccggccacactgggactgagacacggcccagactcctacgggaggcagcagtagggaatcttcggcaatgggcgaaagcctgaccgagcaacgccgcgtgagcgaagaaggccttcgggttgtaaagctcagtcactcgggaagagcgaaccggagagggaatgctctggtngagacggtaccgagagaggaagccccggctaactacgtgccagcagccgcggtaatacgtagggggcgagcgttgtccggaatcactgggcgtaaagcgtgcgtaggcggtttggtaagtccggagtgaaagaccagggctcaaccctgggggtgctttggaaactgccagacttgagtgctggagaggcaaggggaattccacgtgtagcggtgaaatgcgtagagatgtggaggaataccagtggcgaaggcgccttgctggacagtgactgacgctgaggcacgaaagcgtggggagcaaacaggattagataccctggtagtccacgccgtaaacgatgagtgctaggtgttggggggtaccaccctcagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacgggttcagagatgagccgtcccttcggggcagaggagacaggtggtgcatggttgtcgtcagctcgtgtcgtgagatgttgggttaagtcccgcaacgagcgcaacccttgacctgtgttaccagcacgtgaaggtggggactcacaggtgactgccggcgtaagtcggaggaaggtggggatgacgtcaaatcatcatgccctttatgtcctgggctacacacgtgctacaatgggcggtacaacgggaagcgagaccgcgaggtggagcgaaaccctgaaagccgttcgtagttcggattgcaggctgcaactcgcctgcatgaagccggaattgctagtaatcgcggatcagcatgccgcggtgaatccgttcccgggccttgtacacaccgcccgtcacaccacgagagttggcaacacccgaagtcggtgaggtaaccctttagggagccagccgccgaaggtggggtcgatgattggggtgaagtcgtaacaaggtagccgtatcggaagg

SEQ ID NO: 125 - DNA, 1517 bp, Alicyclobacillus cycloheptanicus
agagtttgatcctggctcaggacgaacgctggcggcgtgcctaatacatgcaagtcgagcggacccttcggggtcagcggcggacgggtgagtaacacgtgggtaatctgcccaactgaccggaataacgcctggaaacgggtgctaatgccggataggcagcgagcaggcatctgctcgctgggaaaggtgcaaatgcaccgcagatggaggagcccgcggcgcattagctggttggtggggtaacggctcaccaaggcgacgatgcgtagccgacctgagagggtggacggccacactgggactgagacacggcccagactcctacgggaggcagcagtagggaatcttccgcaatgggcgcaagcctgacggagcaacgccgcgtgagcgaagaaggccttcgggttgtaaagctcagtcactcgggaagagcggcaaggggagtggaaagccccttgagagacggtaccgagagaggaagccccggctaactacgtgccagcagccgcggtaatacgtagggggcaagcgttgtccggaatcactgggcgtaaagcgtgcgtaggcggttgcgtgtgtccggggtgaaagtccagggctcaaccctgggaatgccttggaaactgcgtaacttgagtgctggagaggcaaggggaattccgcgtgtagcggtggaatgcgtagatatgcggaggaataccagtggcgaaggcgccttgctggacagtgactgacgctgaggcacgaaagcgtggggagcaaacaggattagataccctggtagtccacgccgtaaacgatgagtgctaggtgttggggggtaccaccctcagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccccctgacagccgcagagatgcggtttcccttcggggcaggggagacaggtggtgcatggttgtcgtcagctcgtgtcgtgagatgttgggttaagtcccgcaacgagcgcaacccttgaactgtgttaccagcacgtgaaggtggggactcacagttgactgccggcgtaagtcggaggaaggcggggatgacgtcaaatcatcatgccctttatgtcctgggctacacacgtgctacaatgggcggtacaacgggaagcgagaccgcgaggtggagcaaacccctgaaagccgttcgtagttcggattgcaggctgcaactcgcctgcatgaagccggaattgctagtaatcgcggatcagcatgccgcggtgaatccgttcccgggccttgtacacaccgcccgtcacaccacgagagtcggcaacacccgaagtcggtggggtaacccgtcagggggccagccgccgaaggtggggttgatgattggggtgaagtcgtaacaaggtagccgtatcggaaggtgcggttggat

SEQ ID NO: 126 - DNA, 1529 bp, Alicyclobacillus herbarius
  modified_base (1025)..(1025): a, c, t, g, unknown or other
  modified_base (1027)..(1027): a, c, t, g, unknown or other
  modified_base (1135)..(1135): a, c, t, g, unknown or other
  modified_base (1138)..(1138): a, c, t, g, unknown or other
  modified_base (1331)..(1331): a, c, t, g, unknown or other
agagtttgatcctggctcaggacgaacgctggcggcgtgcctaatacatgcaagtcgagcggacggaagggagcttgctcccggacgtcagcggcggacgggtgaggaacacgtgggcaatctgcccatcagtcgggaataacactcggaaacgggtgctaatgccggataggcatcttgggggcatccctgggatgggaaaggcgcttaggcgctgctgatggaggagcccgcggcgcattagctggttggcggggtaacggcccaccaaggcgacgatgcgtagccgacctgagagggtgaccggccacactgggactgagacacggcccagactcctacgggaggcagcagtagggaatcttccgcaatgggcgcaagcctgacggagcaacgccgcgtgagcgaagaaggccttcgggttgtaaagctcagtcaatcgggaagagcgacctagggagggaatgccctaggggagacggtaccgatggaggaagccccggcaaactacgtgccagcagccgcggtaatacgtagggggcgagcgttgtccggaatgactgggcgtaaagcgtgcgtaggcggccttacgcgtctgaggtttaagaccacggctcaaccgtgggggtgccttggaaacggtgaggcttgagtgctggagaggcaaggggaattccacgtgtagcggtgaaatgcgtagagatgtggaggaatacccgtggcgaaggcgccttgctggacagtgactgacgctgaggcacgaaagcgtggggagcaaacaggattagataccctggtagtccacgccgtaaacgatgagtgctaggtgttgggggtgcgagccctcagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacgcactcagagatgggtgttcccntntgggcagaggagacaggtggtgcatggttgtcgtcagctcgtgtcgtgagatgttgggttaagtcccgcaacgagcgcaacccttgacctgtgttaccagcgcgtganggnggggactcacaggtgactgccggcgcaagccggaggaaggcggggatgacgtcaaatcatcatgcccttgatgtcctgggcgacacacgtgctacaatgggcggtacaacgggcagcgagaccgcgaggtggagcgaatccctgaaagccgctcgtagttcggattgcaggctgcaacccgcctgcatgaagncggaattgctagtaatcgcggatcagcatgccgcggtgaatccgttcccgggccttgtacacaccgcccgtcacaccacgagagtgagcaacacccgaagtcggtgaggcaaccggataggagccagccgccgaaggtggggctcgcgattggggtgaagtcgtaacaaggtagccgtatcggaaggtgcggttggat

SEQ ID NO: 127 - DNA, 1528 bp, Alicyclobacillus pomorum
  modified_base (1017)..(1017): a, c, t, g, unknown or other
agagtttgatcctggctcaggacgaacgctggcggcgtgcctaatacatgcaagtcgagcggacggaagggagcttgctcccggaagtcagcggcggacgggtgagtaacacgtgggcaatctgcctgtcagaccggaataacgcctggaaacgggtgctaatgccggataggcaatctggaggcatctctggattgggaaaggcgcggatgcgccactgacagaggagcccgcggcgcattagctagttggtggggtaacggctcaccaaggcgacgatgcgtagccgacctgagagggtgaccggccacactgggactgagacacggcccagactcctacgggaggcagcagtagggaatcttcggcaatgggcgaaagcctgaccgagcaacgccgcgtgagcgaagaaggccttcgggttgtaaagctcagtcactcgggaagagcggtaaggagaggaaatgctcctttcgagacggtaccgagagaggaagccccggctaactacgtgccagcagccgcggtaatacgtagggggcgagcgttgtccggaatcactgggcgtaaagcgtgcgtaggcggtttgttaagtccgaagtgaaagtccagggctcaaccttgggattgctttggaaactggcagacttgagtgctggagaggcaaggggaattccacgtgtagcggtgaaatgcgtagatatgtggaggaataccagtggcgaaggcgccttgctggacagtgactgacgctgaggcacgaaagcgtggggagcaaacaggattagataccctggtagtccacgccgtaaacgatgagtgctaggtgttggggggtaccaccctcagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgaccggtgcagagatgtnccttcccttcggggcagaggagacaggtggtgcatggttgtcgtcagctcgtgtcgtgagatgttgggttaagtcccgcaacgagcgcaacccttgacctgtgttaccagcacgtgatggtggggactcacaggtgactgccggcgtaagtcggaggaaggtggggatgacgtcaaatcatcatgccctttatgtcctgggctacacacgtgctacaatgggcggtacaacgggaagcgagaccgcgaggtggagcgaatccctgaaagccgttcgtagttcggattgcaggctgcaactcgcctgcatgaagccggaattgctagtaatcgcggatcagcatgccgcggtgaatccgttcccgggccttgtacacaccgcccgtcacaccacgagagttggcaacacccgaagtcggtgaggtaaccgcaaggagccagccgccgaaggtggggtcgacgattggggtgaagtcgtaacaaggtagccgtatcggaaggtgcggttggat

SEQ ID NO: 128 - DNA, 1464 bp, Alicyclobacillus sp.
  CCUG 53762
aacgctggcggcgtgcctaatacatgcaagtcgcgcgaacggaaggagagcttgctcttctgaagttagcggcggacgggtgagtaacacgtgggcaacctgcctgacagaccgggataacgcttggaaacgagtgctaataccggataggcaaacgggaggcatctcctgattgagaaaggcgctacggcgtcactgtcagatgggcccgcggcgcattagctagttggtgaggtaacggctcaccaaggcgacgatgcgtagccgacctgagagggtgaccggccacactgggactgagacacggcccagactcctacgggaggcagcagtagggaatcttccacaatgggcgcaagcctgatggagcaacgccgcgtgagtgatgaaggccttcgggttgtaaaactctgtcttctgggacgaacgggcaggagagggaatgctcctgccatgacggtaccagaggaggaagccacggctaactacgtgccagcagccgcggtaatacgtaggtggcaagcgttgtccggaattactgggcgtaaagcgcgcgcaggcggccatttaagtctggggtgaaagcccggggctcaaccccgggattgccttggatactggatggcttgagcatcggagaggcaaggggaattccacgtgtagcggtgaaatgcgtagagatgtggaggaacaccagtggcgaaggcgccttgctggccgattgctgacgctgaggcgcgaaagcgtggggagcaaacaggattagataccctggtagtccacgccgtaaacgatgagtgctaggtgttggcggtttcaataccgtcagtgccgaagctaacgcattaagcactccgcctggggagtacggtcgcaagactgaaactcaaaggaattgacgggggcccgcacaagcagtggagcatgtggtttaattcgaagcaacgcgaagaaccttaccaagacttgacatcccgctgaccggtctagagataggccttcccttcggggcagcggagacaggtggtgcatggttgtcgtcagctcgtgtcgtgagatgttgggttaagtcccgcaacgagcgcaacccttgaactgtgttgccagcattgagttgggcactcacagttgactgccggtgacaaaccggaggaaggcggggatgacgtcaaatcatcatgccccttatgtcttgggctacacacgtgctacaatgggcggtacagagggatgcgaaaccgcgaggtggagcgaaacccttaaagccgttcgtagttcggattgcaggctgcaactcgcctgcatgaagccggaattgctagtaatcgcggatcagcatgccgcggtgaatacgttcccgggccttgtacacaccgcccgtcacaccacgagagttggtaacacccgaagtcggtgaggtaaccttatggagccagccgccgaaggtgggatcgatgattgggg

SEQ ID NO: 129 - DNA, 1384 bp, Alistipes finegoldii
  modified_base (24)..(25): a, c, t, g, unknown or other
  modified_base (27)..(27): a, c, t, g, unknown or other
gtcgaggggcagcggggagtagcnngnctccgccggcgaccggcgcacgggtgcgtaacgcgtatgcaacctacctttaacaggggcataacactgagaaattggtactaattccccataacattcgagaaggcatcttcttgggttaaaaactccggtggttaaagatgggcatgcgttgtattagctagttggtgaggtaacggctcaccaaggcaacgatacatagggggactgagaggttaaccccccacattggtactgagacacggaccaaactcctacgggaggcagcagtgaggaatattggtcaatggacgcaagtctgaaccagccatgccgcgtgcaggaagacggctctatgagttgtaaactgcttttgtactagggtaaacgcttctacgtgtaggagcctgaaagtatagtacgaataaggatcggctaactccgtgccagcagccgcggtaatacggaggatccaagcgttatccggatttattgggtttaaagggtgcgtaggcggtttgataagttagaggtgaaataccggggctcaactccggaactgcctctaatactgttgaactagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgataactcgttgtcggcgatacacagtcggtgactaagcgaaagcgataagttatccacctggggagtacgttcgcaagaatgaaactcaaaggaattgacgggggcccgcacaagcggaggaacatgtggtttaattcgatgatacgcgaggaaccttacccgggcttgaaagttagtgacgattctggaaacaggatttcccttcggggcacgaaactaggtgctgcatggttgtcgtcagctcgtgccgtgaggtgtcgggttaagtcccataacgagcgcaacccctaccgttagttgccatcaggtcaagctgggcactctggcgggactgccggtgtaagccgagaggaaggtggggatgacgtcaaatcagcacggcccttacgtccggggctacacacgtgttacaatggtaggtacagagggccgctaccccgcgaggggatgccaatctcgaaagcctatctcagttcggatcggaggctgaaacccgcctccgtgaagttggattcgctagtaatcgcgcatcagccatggcgcggtgaatacgttcccgggccttgtacacaccgcccgtcaagccatggaagctgggggtgcctgaagttcgtgaccgcaaggagc

SEQ ID NO: 130 - DNA, 1317 bp, Alistipes indistinctus
gataaacgctagcggcaggcctaacacatgcaagtcgagggaccggcgcacgggtgcgtaacgcgtatgcaacctacctttaacagggggataatccgaagaaatttggtctaataccccataatgaaaaatggttagagatgggcatgcgttgtattagctagttggtgaggtaacggctcaccaaggctacgatacatagggggactgagaggttttccccccacactggtactgagacacggaccagactcctacgggaggcagcagtgaggaatattggtcaatggacgcaagtctgaaccagccatgccgcgtgcaggatgaaggtgtatgcattgtaaactgcttttgtacgagggtatgaaagtatcgtacgaataagggtcggctaactccgtgccagcagccgcggtaatacggaggacccgagcgttatccggatttattgggtttaaagggtgcgtaggcggattagtaagttagaggtgaaagctcgatgctcaacatcgaaattgcctctgatactgttagtctagagtatagttgcggaaggcggaatgtgtggtgtagcggtgaaatgcttagatatcacacagaacaccgattgcgaaggcagctttccaagctaactgacgctgatgcacgaaagcgtggggagcgaacaggattagataccctggtagtccacgccgtaaacgatgataactcgttgcaggcgagtctgtgacttagcgaaagcgttaagttatccacctggggagtacgttcgcaagaatgaaactcaaaggaattgacgggggcccgcacaagcggaggaacatgtggtttaattcgatgatacgcgaggaaccttacccgggcttgaaagtactaggtgctgcatggttgtcgtcagctcgtgccgtgaggtgtcgggttaagtcccataacgagcgcaacccctactgttagttaccagcacgtgggcactctagcaggactgccggtgtaagccggaggaaggtggggatgacgtcaaatcagcacggcccttacgtccggggcgacacacgtgttacaatggtcggcagagggtcgctaccccgtgaggggatgccaatctcgccgatctcagttcggatggaggctgaaactcgcctccagaagttggattcgctagtaatcgcgcatcagccatggcgcggtgaatacgttcccgggccttgtacacaccgcccgtcaagccatgggagttgggggtgcctgaagtacgtgcgtcctagggcaaaaccgatgactggggctaagtcgtaacaaggtagccgtaccggaagg

SEQ ID NO: 131 - DNA, 932 bp, Alistipes onderdonkii
  modified_base (16)..(16): a, c, t, g, unknown or other
  modified_base (18)..(18): a, c, t, g, unknown or other
  modified_base (99)..(99): a, c, t, g, unknown or other
  modified_base (137)..(137): a, c, t, g, unknown or other
  modified_base (151)..(151): a, c, t, g, unknown or other
atcgtacgaataaggntnggctaactccgtgccagcagccgcggtaatacggaggattcaagcgttatccggatttattgggtttaaagggtgcgtagncggtttgataagttagaggtgaaatcccggggcttaantccggaactgcctntaatactgttagactagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgataactcgttgtcggcgatacacagtcggtgactaagcgaaagcgataagttatccacctggggagtacgttcgcaagaatgaaactcaaaggaattgacgggggcccgcacaagcggaggaacatgtggtttaattggatgatacgcgaggaaccttacccgggcttgaaagttactgacgattctggaaacaggatttcccttcggggcaggaaactaggtgctgcatggttgtcgtcagctcgtgccgtgaggtgtcgggttaagtcccataacgagcgcaacccctaccgttagttgccatcaggtcaagctgggcactctggcgggactgccggtgtaagccgagaggaaggtggggatgacgtcaaatcagcacggcccttacgtccggggctacacacgtgttacaatggtaggtacagagggtcgctaccccgtgaggggatgccaatctcgaaagcctatctcagttcggattggaggctgaaacccgcctccatgaagttggattcgctagtaatcgcgcatcagccatggcgcggtgaatacgttcccgggccttgtacacaccgcccgtcaagccatggaagctg

SEQ ID NO: 132 - DNA, 1523 bp, Alistipes putredinis
gagagtttgatcctggctcaggatgaacgctagcggcaggcttaacacatgcaagtcgaggggcagcataatggatagcaatatctatggtggcgaccggcgcacgggtgcgtaacgcgtatgcaacctacctttaacagggggataacactgagaaattggtactaataccccataatatcatagaaggcatcttttatggttgaaaattccgatggttagagatgggcatgcgttgtattagctagttggtggggtaacggctcaccaaggcgacgatacatagggggactgagaggttaaccccccacactggtactgagacacggaccagactcctacgggaggcagcagtgaggaatattggtcaatggacgcaagtctgaaccagccatgccgcgtgcaggatgacggctctatgagttgtaaactgcttttgtacgagggtaaacgcagatacgtgtatctgtctgaaagtatcgtacgaataaggatcggctaactccgtgccagcagccgcggtaatacggaggattcaagcgttatccggatttattgggtttaaagggtgcgtaggcggtttgataagttagaggtgaaatttcggggctcaaccctgaacgtgcctctaatactgttgagctagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgataactcgttgtcggcgatacacagtcggtgactaagcgaaagcgataagttatccacctggggagtacgttcgcaagaatgaaactcaaaggaattgacgggggcccgcacaagcggaggaacatgtggtttaattcgatgatacgcgaggaaccttacccgggcttgaaagttagcgacgattcttgaaagaggatttcccttcggggcgcgaaactaggtgctgcatggttgtcgtcagctcgtgccgtgaggtgtcgggttaagtcccataacgagcgcaacccctaccgttagttgccatcaggtgaagctgggcactctggcgggactgccggtgtaagccgagaggaaggtggggatgacgtcaaatcagcacggcccttacgtccggggctacacacgtgttacaatggtaggtacagagggcagctacccagcgatgggatgcgaatctcgaaagcctatctcagttcggattggaggctgaaacccgcctccatgaagttggattcgctagtaatcgcgcatcagccatggcgcggtgaatacgttcccgggccttgtacacaccgcccgtcaagccatgggagccgggggtgcctgaagttcgtgaccgcaaggagcgacctagggcaaaactggtgactggggctaagtcgtaacaaggtagccgtaccggaaggtgcggctggaacacctcctttct

SEQ ID NO: 133 - DNA, 1355 bp, Alistipes shahii
  modified_base (753)..(753): a, c, t, g, unknown or other
gcaatacactggtggcgaccggcgcacgggtgcgtaacgcgtatgcaacctacccataacagggggataacactgagaaattggtactaataccccataacatcaggaccggcatcggttttggttgaaaactccggtggttatggatgggcatgcgttgtattagctggttggtgaggtaacggctcaccaaggcaacgatacatagggggactgagaggttaaccccccacattggtactgagacacggaccaaactcctacgggaggcagcagtgaggaatattggtcaatggacgcaagtctgaaccagccatgccgcgtgcaggaagacggctctatgagttgtaaactgcttttgtacgagggtaaacgctcttacgtgtaagagcctgaaagtatcgtacgaataaggtcggctaactcgtgccagcagccgcggtaatacggaggcaagcgttatccggatttattgggtttaaagggtgcgtaggcggtttgataagttagaggtgaaataccggtgcttaacaccggaactgcctctaatactgttgactagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgataactcgctgtcggcgatacacngtcggcggctaagcgaaagcgataagttatccacctggggagtacgttcgcaagaatgaaactcaaaggaattgacgggggcccgcacaagcggaggaacatgtggtttaattcgatgatacgcgaggaaccttacccgggcttgaaagttactgacgattctggaaacaggatttcccttcggggcaggaaactaggtgctgcatggttgtcgtcagctcgtgccgtgaggtgtcgggttaagtcccataacgagcgcaacccctaccgttagttgccatcaggtcaagctgggcactctggcgggactgccggtgtaagccgagaggaaggtggggatgacgtcaaatcagcacggcccttacgtccggggctacacacgtgttacaatggtaggtacagagggcagctacccagtgatgggatgcgaatctcgaaagcctatctcagttcggatcggaggctgaaacccgcctccgtgaagttggattcgctagtaatcgcgcatcagccatggcgcggtgaatacgttcccgggccttgtacacaccgcccgtcaagccatggaagctgggggtgcctgaagttcgtgaccgcaagga

SEQ ID NO: 134 - DNA, 1432 bp, Alistipes sp.
  HGB5
ggcgaccggcgcacgggtgcgtaacgcgtatgcaacctacctttaacaggggcataacactgagaaattggtactaattccccataacattcgagaaggcatcttcttgggttaaaaactccggtggttaaagatgggcatgcgttgtattagctagttggtgaggtaacggctcaccaaggcaacgatacatagggggactgagaggttaaccccccacattggtactgagacacggaccaaactcctacgggaggcagcagtgaggaatattggtcaatggacgcaagtctgaaccagccatgccgcgtgcaggaagacagctctatgagttgtaaactgcttttgtactagggtaaacgctcctacgtgtaggagtctgaaagtatagtacgaataaggatcggctaactccgtgccagcagccgcggtaatacggaggatccaagcgttatccggatttattgggtttaaagggtgcgtaggcggtttgataagttagaggtgaaataccggggctcaactccggaactgcctctaatactgttgaactagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgataactcgttgtcggcgatacacagtcggtgactaagcgaaagcgataagttatccacctggggagtacgttcgcaagaatgaaactcaaaggaattgacgggggcccgcacaagcggaggaacatgtggtttaattcgatgatacgcgaggaaccttacccgggcttgaaagttagtgacgattctggaaacaggatttcccttcggggcacgaaactaggtgctgcatggttgtcgtcagctcgtgccgtgaggtgtcgggttaagtcccataacgagcgcaacccctaccgttagttgccatcaggtcaagctgggcactctggcgggactgccggtgtaagccgagaggaaggtggggatgacgtcaaatcagcacggcccttacgtccggggctacacacgtgttacaatggtaggtacagagggccgctaccccgtgaggggatgccaatctcgaaagcctatctcagttcggatcggaggctgaaacccgcctccgtgaagttggattcgctagtaatcgcgcatcagccatggcgcggtgaatacgttcccgggccttgtacacaccgcccgtcaagccatggaagctgggggtgcctgaagttcgtgaccgcaaggagcgacctagggcaaaaccggtgactggggctaagtcgtaacaaggtagccgtaccggaaggtgcggctggaacacctcctttct

SEQ ID NO: 135 - DNA, 1480 bp, Alistipes sp.
  JC50
tgatcctggctcaggatgaacgctagcggcaggcctaacacatgcaagtcgaggggcagcgggattgaagcttgcttcaattgccggcgaccggcgcacgggtgcgtaacgcgtatgcaacctacccataacagggggataacactgagaaatcggtactaatatcccataacatcatgaggggcatcccttatggttgaaaactccggtggttatggatgggcatgcgttgtattagctggttggtgaggtaacggctcaccaaggcgacgatacatagggggactgagaggttaaccccccacattggtactgagacacggaccaaactcctacgggaggcagcagtgaggaatattggtcaatggacgcaagtctgaaccagccatgccgcgtgcaggatgacggctctatgagttgtaaactgcttttgtacgagggtaaacccggatacgtgtatccggctgaaagtatcgtacgaataaggatcggctaactccgtgccagcagccgcggtaatacggaggattcaagcgttatccggatttattgggtttaaagggtgcgtaggcggtttgataagttagaggtgaaataccggtgcttaacaccggaactgcctctaatactgttgagctagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgataactcgctgtcggcgatacacagtcggtggctaagcgaaagcgataagttatccacctggggagtacgttcgcaagaatgaaactcaaaggaattgacgggggcccgcacaagcggaggaacatgtggtttaattcgatgatacgcgaggaaccttacccgggcttgaaagttactgacgattctggaaacaggatttcccttcggggcaggaaactaggtgctgcatggttgtcgtcagctcgtgccgtgaggtgtcgggttaagtcccataacgagcgcaacccctaccgttagttgccatcaggtcaagctgggcactctggcgggactgccggtgtaagccgagaggaaggtggggatgacgtcaaatcagcacggcccttacgtccggggctacacacgtgttacaatggtaggtacagagggcagctacccagtgatgggatgcgaatctcgaaagcctatctcagttcggattggaggctgaaacccgcctccatgaagttggattcgctagtaatcgcgcatcagccatggcgcggtgaatacgttcccgggccttgtacacaccgcccgtcaagccatggaagctgggggtgcctgaagttcgtgaccgcaaggagcgacctagggcaaaaccggtgactggggctaagtcgtaacaaggta

SEQ ID NO: 136 - DNA, 1304 bp, Alistipes sp.
  RMA 9912
gctcaggatgaacgctagcggcaggcctaacacatgcaagtcgagggaccggcgcacgggtgcgtaacgcgtatgtaacctacctataacaggggcataacactgagaaattggtactaattccccataatgaaaagtggttatagatggacatgcgttgtattagctagttggtgaggtaacggctcaccaaggcaacgatacatagggggactgagaggttaaccccccacactggtactgagacacggaccagactcctacgggaggcagcagtgaggaatattggtcaatggacgcaagtctgaaccagccatgccgcgtgcaggaagacggcttatgagttgtaaactgcttttgtacgagggtatgaaagtatcgtacgaataaggatcggctaactccgtgccagcagccgcggtaatacggaggattcaagcgttatccggatttattgggtttaaagggtgcgtaggcggtttgataagttagaggtgaaatcccggggcttaactccggaactgcctctaatactgttagactagagagtagttgcggtaggcggaatgtatggtgtagcggtgaaatgcttagagatcatacagaacaccgattgcgaaggcagcttaccaaactatctgacgttgaggcacgaaagcgtggggagcaaacaggattagataccctggtagtccacgcagtaaacgatgataactcgttgtcggcgagtcggtgactaagcgaaagcgataagttatccacctggggagtacgttcgcaagaatgaaactcaaaggaattgacgggggcccgcacaagcggaggaacatgtggtttaattcgatgatacgcgaggaaccttacccgggcttgaaagtactaggtgctgcatggttgtcgtcagctcgtgccgtgaggtgtcgggttaagtcccataacgagcgcaacccctaccgttagttgccatcagctgggcactctggcgggactgccggtgtaagccggaggaaggtggggatgacgtcaaatcagcacggcccttacgtccggggctacacacgtgttacaatggtaggcagagggtcgctactccgtgaggagatgccaatctcgcctatctcagttcggatggaggctgaaacccgcctccagaagttggattcgctagtaatcgcgcatcagccatggcgcggtgaatacgttcccgggccttgtacacaccgcccgtcaagccatggaagctgggggtgcctgaagttcgtgcgacctagggcaaaaccggtaactggggctaagtcgtaaca

SEQ ID NO: 137 - DNA, 1404 bp, Alkaliphilus metalliredigenes
  modified_base (133)..(133): a, c, t, g, unknown or other
  modified_base (151)..(151): a, c, t, g, unknown or other
  modified_base (674)..(675): a, c, t, g, unknown or other
cctccttagagtttgatcctggctcaggatgaacgctggcggcgtgcctaacacatgcaagtcgagcgggttaatctgacggaagccttcgggtggaagaaagtgaaactagcggcggacgggtgagtaacgncgtgggcaacctaccttngtacagggggacaacaacgggaaaccgttgctaataccccataaaaccctagaggggcatcccttaagggtcaaagaatttcggtacaagatgggcccgcgtctgattagctagttggtgaggtaatggctcaccaaggcgacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctaggggaagaatattgacggtaccctaggaggaagccccggctaactacgtgccagcagccgcggtaatacgtagggggcaagcgttatccggaatcactgggcgtaaagggtgcgtaggcggtcttgcaagtcagaggtgaaaggctacggctcaaccgtagtaagcctttgaaactgctaagacttgagtatgggagaggaaagtggaattcctagnntagcggtgaaatgcgtagatattaggaggaacaccagtggcgaaggcgactttctggacccattactgaccgctgaggcacgaaaagcgtgggggagcaaacaggattagataccctggtagtccacgccgtaaacaatgagtgctaggatgttgggggtcgaacctcagtgccgcagctaacgcattaagcactccgcctggggagtacgctcacaagcagtgaaactcaaaggaattgactggggacccgcacaagcagctggagcatgtggtttaattcgaagcaacgcgaagaaccttacctggacgttgacatccctcggaccactccttaaccggagtcttcccttcggggactgaggtgacaggtggtgcatggttgtcgtcagctcgtgtcgtgagatgttgggttaagtcccgcaacgagcgcaacccttgtctttagttgccagcagttcggctgggcactctagagagactgccggggataactcggaggaaggtggggatgacgtcaaatcatcatgccccttatgttcagggctacacacgtgctacaatggccgatacaacgggcagcgaaggagtaatccggagcaaatcctataaagtcggtcccagttcggattgtgggctgaaactcgcccacatgaagctggagttgctagtaatcgcgaatcagaatgtctgcggtgaatgcgttcccgggtcttgtacactaccagcc

SEQ ID NO: 138 - DNA, 1314 bp, Alkaliphilus oremlandii
aataccccatgacgccttttgggggcatccctaaaaggtcaaagaacttcggtacaggatgggcccgcgtctgattagctagttggtgaggtaatggctcaccaaggcgacgatcagtagccggcctgagagggtgaacggccacactggaactgagacacggtccagactcctacgggaggcagcagtggggaatattgcacaatgggggaaaccctgatgcagcaacgccgcgtgagcgatgaaggccttcgggtcgtaaagctctgtcctaagggaagataatgacggtaccttaggaggaagccccggctaactacgtgccagcagccgcggtaatacgtagggggcaagcgttatccggaatcattgggcgtaaagggtgcgtaggctgccctataggtcagaggtcaaaggctacggctcaaccgtagtaagcctttgaaactgtagggcttgagtgcaggagaggagagtggaattcctagtgtagcggtgaaatgcgtagatattaggaggaacaccagtggcgaaggcgactctctggactgcaactgacgctgaggcacgaaagcgtgggtagcgaacaggattagataccctggtagtccacgccgtaaacgatgagtgctaggtgttgggggtcgaacctcggtgccgaagttaacgcattaagcactccgcctggggagtacgtacgcaagtatgaaactcaaaggaattgacggggacccgcacaagcagcggagcatgtggtttaattcgaagcaacgcgaagaaccttacctggacttgacatccctctgaccgattcttaaccgaatccttcccttcggggacagaggagacaggtggtgcatggttgtcgtcagctcgtgtcgtgggatgttgggttaagtcccgcaacgagcgcaacccttgtctttagttgccatcattaagttgggcactctagagagactgccggggataactcggaggaaggtggggatgacgtcaaatcatcatgccccttatgttcagggctacacacgtgctacaatggccgatacaacgggcagcgaaagagtaatctggagcaaatcctacaaaatcggtcccagttcggattgtgggctgaaactcgcccacatgaagttggagttgctagtaatcgcggatcagaatgtcgcggtgaatgcgttcccgggtcttgtacacaccgcccgtcacaccatgggagttggaagcacccgaagccagctatctaaccgtaaggaggaagctgtcgaaggtgaagctaatgactggggtgaagtcgtaacaaggtagccg

SEQ ID NO: 139 - DNA, 1482 bp, Alloscardovia omnicolens
gacgaacgctggcggcgtgcttaacacatgcaagtcgaacgggatcctttctagcttgctaggggggtgagagtggcgaacgggtgagtaacgcgtgattaacctgccgtgtagtttggaatagctcctggaaacgggtggtaatgccgaatgttccacatgctcgcatgggtgtgtgggaaaacgttttagtgctatgcgatgggatcgcgtcctatcagcttgttggtggggtagtggcctaccaaggcttcgacgggtagccggcctgagagggcgaccggccacattgggactgagatacggcccagactcctacgggaggcagcagtggggaatattgcacaatggggggaaccctgatgcagcgacgccgcgtgcgggatgacggccttcgggttgtaaaccgcttttattggggagcaagcgtgagtgagtgtaccttttgaataagcaccggctaactacgtgccagcagccgcggtaatacgtagggtgcaagcgttgtccggaattattgggcgtaaagagctcgtaggcggtttgtcgcgtctggtgtgaaagtccatcgcttaacggtggattggcgctgggtacgggcaggctagagtgtagtaggggagactggaattctcggtgtaacggtggaatgtgtagatatcgggaagaacaccaatggcgaaggcaggtctctgggctattactgacgctgaggagcgaaagcgtggggagcgaacaggattagataccctggtagtccacgccgtaaacggtggatgctggatgtggggccctttccacgggttctgtgtcggagctaacgcgttaagcatcccgcctggggagtacggccgcaaggctaaaactcaaagaaattgacgggggcccgcacaagcggcggagcatgcggattaattcgatgcaacgcgaagaaccttaccaagacttgacatgttaacgatggcctcagagatggggtgtctcttcggagcgttttcacaggtggtgcatggtcgtcgtcagctcgtgtcgtgagatgttgggttaagtcccgcaacgagcgcaacccttgtcttgtgttgccagcacgttatggtgggaactcacaagagaccgccggggttaactcggaggaaggtggggatgacgtcagatcatcatgccccttacgtcttgggcttcacgcatgctacaatggccggtacagcgaggtgcgatagggtgacctggagcggatctctgaaaaccggtctcagttcggatcggagcctgcaactcggctccgtgaaggtggagtcgctagtaatcgcagatcagcaacgctgcggtgaatgcgttcccgggccttgtacacaccgcccgtcaagtcatgaaagtgggcagcacccgaagccggtggcctaacagtttttgctgggggagccgtctaaggtgaggttcgcgattgggactaagtcgtaacaaggtagccgtaccggaagg

SEQ ID NO: 140 - DNA, 1230 bp, Alloscardovia sp.
  OB7196
cgaacgagtggcgaacgggtgagtaacgcgtgatcaacctgccgtgtagtggggaatagctcctggaaacgggtggtaatgccctatgttgaaaggtgctatgcgatgggatcgcgtcctatcagcttgttggtggggtaatggcctaccaaggcttcgacgggtagccggcctgagagggcgaccggccacattgggactgagatacggcccagactcctacgggaggcagcagtggggaatattgcacaatgggggaaaccctgatgcagcgacgccgcgtgcgggatgacggccttcgggttgtaaaccgcttttaattgggagcatgagtgtaccttttgaataagcaccggctaactacgtgccagcagccgcggtaatacgtagggtgcaagcgttgtccggaattattgggcgtaaagagctcgtaggcggtttgtcgcgtctggtgtgaaagtccatcgcttaacggtggatttgcgctgggtacgggcaggctagagtgtagtaggggagactggaattcccggtgtaacggtggaatgtgtagatatcgggaagaacaccaatggcgaaggcaggtctctgggctaactgacgctgaggagcgaaagcgtggggagcgaacaggattagataccctggtagtccacgccgtaaacggtggatgctggatgtggggcgttctgtgtcggagctaacgcgttaagcatcccgcctggggagtacggccgcaaggctaaaactcaaagaaattgacgggggcccgcacaagcggcggagcatgcggattaattcgatgcaacgcgaagaaccttaccaagacttgacatgcacaggtggtgcatggtcgtcgtcagctcgtgtcgtgagatgttgggttaagtcccgcaacgagcgcaacccttgtcttgtgttgccagcacgtgggaactcacaagagaccgccggggttaactcggaggaaggtggggatgacgtcagatcatcatgccccttacgtcttgggcttcacgcatgctacaatggccggcagcgaggtgcgatagggtgacctggagcggatctctgccggtctcagttcggatggagcctgcaactcggctccagaaggtggagtcgctagtaatcgcagatcagcaacgctgcggtgaatgcgttcccgggccttgtacacaccgcccgtcaagtcatgaaagtgggcaacacccgaagccggtgcctagg

SEQ ID NO: 141 - DNA, 1528 bp, Anaerobaculum hydrogeniformans
agagtttgatcctggctcaggacgaacgctggcggcgcgcttaacacatgcaagtcgtgcgatacctcgagcgagtcttacgacaagctcaaggtagagcggcggacgggtgagtaacacgtgagtagctgtcctaaggagggggataacgcctggaaacgggtgctaaaaccccatatgcctcgcaagaggtgaaaatgtagcttgctacagccttagggtgtgctcgcggcctatcagctagttggtgaggtaacggctcaccaaggctaagacgggtagccggcctgagagggtgtacggccacactggaattgagatacggtccagactcctacgggaggcagcagtggggaatcttgggcaatgggcgaaagcctgacccagcgacgccgcgttggggatgaagcccttcggggtgtaaacccatgttgtaggggacgaagaaagtgacggtaccctacgaggaagccccggctaactacgtgccagcagccgcggtaagacgtagggggcaagcgttgtccggaattactgggcgtaaagggcacgcaggcggtgcgccaagtcgagggtgtaaagttacggctcaaccgtgacattgcaatcgatactggcgcgctggagtgcgggagagggaagtggaattcccggtgtagcggtgaaatgcgtagatatcgggaggaacgccagtggcgaaggcggcttcctggcccgcgactgacgctcatgtgcgaaagccaggggagcgaaccggattagatacccgggtagtcctggccgtaaacgatgggtgctaggtgtaggcgcgtcaagcgtctgtgccgcagttaacgcgataagcacctcgcctggggagtacggtcgcaaggctgaaactcaaaggaattgacgggggcccgcacaagcggtggagcacgtggtttaattcgatgcaaaccgaagaaccttacctgggtttgacatgcaggtggtacgaacctgaaagggcgaggaccatatcttcggatgtggagcctgcacaggtgctgcatggctgtcgtcagctcgtgtcgtgagatgttgggttaagtcccgcaacgagcgcaacccctgcgcctagttgccatcagttaggctgggcactctaggcggactgccggcgacaagtcggaggaaggtggggatgacgtcaagtcatcatggcctttaagcccagggcgacacacgtgctacaatggccagcacagagggcggcaagtccgcgagggcaagcgaatcccttaaagctggtcttagttcggatcgcagtctgcaacccgactgcgtgaagccggaatcgctagtaatcgccggtcagccatacggcggtgaatacgttcccgggccttgtacacaccgcccgtcacaccacccgagttgggtgctcccgaagccgccggcccaacccctttttggggagggaggcgtcgaaggagtgtctgataaggggggtgaagtcgtaacaaggtagccgtaccggaaggtgcggctggatcacctcctttct

SEQ ID NO: 142 - DNA, 1468 bp, Anaerobiospirillum succiniciproducens
gctggcggcaggcctaatacatgcaagtcgaacggtaacagcagagagcttgctctttggctgacgagtggcggacgggtgagtaaggcttgggaatctgcctggtagtgggggacaacagttggaaacgactgctaataccgcatactcccttcgggggaaagacttcggttgctatcagatgagcccaagtgggattagctagtaggtgaggtaaaggctcacctaggcgacgatctctagctggtctgagaggatgatcagccacattgggactgagacacggcccagactcctacgggaggcagcagtagggaatattgcacaatgggggaaaccctgatgcagccatgccgcgtgtgtgaagaaggccttcgggttgtaaagcactttcagtggggaggaaacactgacgttacccacagaagaagcaccggctaactccgtgccagcagccgcggtaatacggagggtgcaagcgttaatcggaataactgggcgtaaagggcatgtaggcggaaaggtaagtaggatgtgaaatacccgggctcaacctgggttggtcattctaaactgcctttctagagtattgcagagggagatggaatttcaggtgtagcggtggaatgcgtagatatctgaaagaacaccagaggcgaaggcggtctcctgggcaaatactgacgctgaggtgcgaaagcgtggggagcaaacaggattagataccctggtagtccacgccgtaaacgatgtcgattaggagcttgaacttcggtttgggttccgcagctaacgcgataaatcgaccgcctggggagtacggccgcaaggttaaaactcaaatgaattgacgggggcccgcacaagcggtggagcatgtggtttaattcgaagcaacgcgaagaaccttacctgaccttgacatcgtaggaatctttyagagatragagagtgccttcgggaacctacagacaggtgctgcatggctgtcgtcagctcgtgtcgtgagatgttgggttaagtcccgcaacgagcgcaacccttgtcctttgttgccaacaggtaaagctgggaactcaaaggagactgccggtgacaaaccggaggaaggtagggatgacgtcaagtcatcatggcccttacggtcagggctacacacgtgctacaatggggcgtacagagggaaacgataccgtgaggtggagtggaacccacaaagcgtcccgcagttcggattggagtctgcaactcgactccatgaagtcggaatcgctagtaatcgcaaatcagaatgttgcggtgaatacgttcccgggccttgtacacaccgcccgtcacaccatgggagcggattgcaccagaagtagttagcttaaccgaaaggagggcgattaccacggtgtggtctgtgactggggtgaagtcgtaacaaggtaaccgtaggggaacctgcggttggatcacctcc

SEQ ID NO: 143 - DNA, 1494 bp, Anaerobiospirillum thomasii
cctggctcagattgaacgctggcggcaggcctaatacatgcaagtcgaacggtaacagtaagatagcttgctatcttagctgacgagtggcggacgggtgagtaaagtctgggaaactgcctgatagagggggacaacagctggaaacggctgctaataccgcatacaccctgagggggaaaggagcaatccgctatcagatgtgcccagatgggattagctagtaggtgtggtaagggcgcacctaggcgacgatctctagctggtctgagaggatgatcagccacattgggactgagacacggcccagactcctacgggaggcagcagtagggaatattgcacaatggggggaaccctgatgcagccatgcccgctgtgtgaagaaggccttcgggttgtaaagcactttcagtggggaggaaatcgcaagagtgacgttacccacagaagaagcaccggctaactccgtgccagcagccgcggtaatacggagggtgcaagcgttaatcggaataactgggcgtaaagggcatgtaggcggatagtcaagtaaggtgtgaaagccccgggctcaacctgggaactgcactttaaactaactatctagagtattgcagagggaaatggaattccaggtgtagcggtgaaatgcgtagatatctggaagaacaccagaggcgaaggcgatctcctgggcagatactgacgctgaggtgcgaaagcgtggggagcaaacaggattagataccctggtagtccacgccgtaaacgatgtcgattagaagcttgagcgatagtttgggtttcgtagctaacgcgctaaatcgaccgcctggggagtacggccgcaaggttaaaactcaaatgaattgacgggggcccgcacaagcggtggagcatgtggtttaattcgatgcaacgcgaagaaccttacctgaccttgacatcgtaggaatgaataagagattattcagtgccttcgggagcctatagacaggtgctgcatggctgtcgtcagctcgtgtcgtgagatgttgggttaagtcccgcaacgagcgcaacccttgtcctttgttgccagcgggtaaagccgggaactcaaaggagactgccagtgacaaactggaggaaggcagggatgacgtcaagtcatcatggcccttacggtcagggctacacacgtgctacaatggggcgtacagagggagacgaaaccgcgaggtggagtggagcccacaaagcgtcccgcagttcggattggagtctgcaactcgactccatgaagtcggaatcgctagtaatcgcaaatcagaatgttgcggtgaatacgtccccgggccttgtacacaccgcccgtcacaccatgggagtgaattgcaccagaagtagttagcctaaccgcaaggagggcgattaccacggtgtggtttatgactggggtgaagtcgtaacaaggtaaccataggggaacctgtggctggatcacctcct

SEQ ID NO: 144 - DNA, 1530 bp, Anaerococcus hydrogenalis
tttaattgagagtttgatcctggctcaggataaacgctggcggcgtgcataacacatgcaagtcgaacgatgaaacttagatgatttcttcggaatgaacttaagtggattagtggcgaacgggtgagtaacacgtgagtaacctgccttacacaaggggatagcctctggaaacggagaataataccctataaagtctaatcagcccatgctggaaagaccaaagatttatcggtgtaagatggacttgcgtctgattagctagttggtgagataaaagctcaccaaggcgacgatcagtagccggcttgagagagtgtacggccacattgggactgagacacggcccaaactcctacgggaggcagcagtggggaattttgcacaatgggggaaaccctgatgcagcgacgccgcgtgatttagaaggccttcgggttgtaaaaatcttttttacgggatgaaaatgacagtaccgtaagaataaggtccggctaaatacgtgccagcagccgcggtaatacgtatggaccgagcgttgtccggaatcattgggcgtaaagggtacgtaggcggcctagtaagttagaagttaaagaatatagctcaactatataaagcttttaaaactgctaggcttgagagatggaagggaaagtggaattcctagtgtagcggtgaaatgcgcagatattaggaagaataccggtggcgaaggcgactttctggtcatcatctgacgctgaggtacgaaagcgtgggtagcaaacaggattagataccctggtagtccacgctgtaaacgatgagtgttaggttcttggaataatctgggagccgcagctaacgcattaaacactccgcctggggagtacgcacgcaagtgtgaaactcaaaggaattgacggggacccgcacaagcagcggagcatgtggtttaattcgacgcaacgcgaagaaccttaccaagtcttgacatatttcggagggaattagagataattccttacgacttcggtcgactgaaatacaggtggtgcatggttgtcgtcagctcgtgtcgtgagatgttgggttaagtcccataacgagcgcaacccctatcgttagttaccatcattaagttggggactctagcgatactgccggtgataaaccggaggaaggtggggacgacgtcaaatcatcatgccctttatgacttgggctacacacgtgctacaatggcagatacagagggcagcgaaagagtgatctgaagcgaaactcacaaaatctgtcccagttcggattgtactctgcaactcgagtacatgaagttggagttgctagtaatcgcgaatcagaatgtcgcggtgaatgcgttcccgggtcttgtacacaccgcccgtcacaccatggaagttggcaatacccgaagcctgtgagcgaaccttttaggacgcagcagtcgaaggtagggtcagtaactggggtgaagtcgtaacaaggtagccgtatcggaaggtgcggctggatcacctcctttct

SEQ ID NO: 145 - DNA, 1426 bp, Anaerococcus lactolyticus
tggattagtggcggacgggtgagtaacgcgtgagtaacctgccttagagaaggggatagcctttggaaacgaagaataataccctataacaccaacacctcgcatgaagagttggtcaaagatttatcgctctaagatggacttgcgtctgattagttagttggtgaggtaacggcccaccaagacagcgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttctatgggaagaaaatgacagtaccataggaataaggaccggctaattacgtgccagcagccgcggtaatacgtaaggtccgagcgttgtccggaatcattgggcgtaaagggtacgtaggcgggtaagcaagttagaagtgaaatcctgtagctcaactacagtaagcttttaaaactgctcatcttgagatatggaagggaaagtggaattcctagtgtagcggtgaaatgcgcagatattaggaggaataccggtggcgaaggcgactttctggccataatctgacgctgaggtacgaaagcgtgggtagcaaacaggattagataccctggtagtccacgccgtaaacgatgagtgttaggtgtctggagtaaatctgggtgccgcagctaacgcattaaacactccgcctggggagtacgcgcgcaagcgtgaaactcaaaggaattgacggggacccgcacaagcagcggagcatgtggtttaattcgacgcaacgcgaagaaccttaccaagtcttgacatattacggcgggagctagagatagttccttacttcttcggaagactgtaatacaggtggtgcatggttgtcgtcagctcgtgtcgtgagatgttgggttaagtcccataacgagcgcaacccctatcgttagttaccatcattaagttggggactctaacaatactgccggtgacaaaccggaggaaggtggggatgacgtcaaatcatcatgccctttatgacttgggctacacacgtgctacaatggcaggtacacagagcagctaaacagcgatgtcacgcgaatctcaaaaagcctgtcccagttcggattgcactctgcaactcgagtgcatgaagttggagttgctagtaatcgtggatcagaatgccgcggtgaatgcgttcccgggtcttgtacacaccgcccgtcacaccatggaagttggcaatacccgaagcctgtgagcgaacccttgtggacgcagcagtcgaaggtagggtcagtaactggggtgaagtcgtaacaaggtagccgtatcggaaggtgcggctggatcacctcctttct

SEQ ID NO: 146 - DNA, 1407 bp, Anaerococcus octavius
gattaacgctggcggcgtgcataacacatgcaagtcgaacgatgaaacttaaatgatttcttcggaatgaacttaagtggattagtggcggacgggtgagtaacgcgtgagtaacctgccttacacaaggggatagccgttggaaacgacgaataataccctatgaaactatcacttcgcatgaagcgatagtcaaagtgttagcggtgtaagatggacttgcgtctgattagctagttggtgagaaaaaagcccaccaaggcaacgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttgtataggaagaaaatgacagtactatacgaataaggtccggctaattacgtgccagcagccgcggtaatacgtaaggaccgagcgttgtccggaatcattgggcgtaaagggtacgtaggcgggtcattaagttagaagtcaaaggctatagctcaactatagtaagcttctaaaactggagaccttgagtaatggaagggaaagtggaattcctagtgtagcggtggaatgcgcagatattaggaggaataccggtggcgaaggcgactttctggccattaactgacgctgaggtacgaaagcgtgggtagcaaacaggattagataccctggtagtccacgccgtaaacgatgagtgttaggtgtctggagtaaatctgggtgccgcagctaacgcattaaacactccgcctggggagtacgcacgcaagtgtgaaactcaaaggaattgacggggacccgcacaagcagcggagcatgtggtttaattcgaagcaacgcgaagaaccttaccaagtcttgacatattttggaagcacttagagataagtgcctatatcttcggataactgaaatacaggtggtgcatggttgtcgtcagctcgtgtcgtgagatgttgggttaagtcccataacgagcgcaacccctatggctagttaccatcattaagttggggactctagcaatactgccggtgacaaaccggaggaaggtggggatgacgtcaaatcatcatgccctttatgacttgggctacacacgtgctacaatggcaggtacagagggcagcaagacagcgatgttaagcaaaactcaaaaagcctgtcccagttcggattgcactctgcaactcgagtgcatgaagttggagttgctagtaatcgtggatcagaatgccacggtgaatgcgttcccgggtcttgtacacaccgcccgtcacaccatggaagttggcaatacccgaagcctgtgagcgaacc

SEQ ID NO: 147 - DNA, 1521 bp, Anaerococcus prevotii
agagtttgatcctggctcaggataaacgctggcggcgtgcataacacatgcaagtcgaacgatgaagcttaaatgatctcttcggagtgaccttaagtggattagtggcggacgggtgagtaacgcgtgagtaacctgccttgcacaaggggatagccgttggaaacgacgaataataccctatgatatgatagcctcgcatgaagctatcatcaaagatttatcggtgtaagatggactcgcgtctgattagctagttggtggggtaacagctcaccaaggcaacgatcagtagccggcttgagagagtgtacggccacattgggactgagacacggcccagactcctacgggaggcagcagtggggaattttgcacaatgggggcaaccctgatgcagcgacgccgcgtgatttagaaggccttcgggttgtaaaaatcttttgtatgggaagaaaatgacagtaccatacgaataaggaccggctaattacgtgccagcagccgcggtaatacgtaaggtccgagcgttgtccggaatcattgggcgtaaagggtacgtaggcggataagcaagttagaagtgaaatcctatagctcaactatagtaagcttttaaaactgctcatcttgaggtatggaagggaaagtggaattcctagtgtagcggtgaaatgcgcagatattaggaggaataccagtggcgaaggcgactttctggccataaactgacgctgaggtacgaaagcgtgggtagcaaacaggattagataccctggtagtccacgccgtaaacgatgagtgttaggtgtctggaataatctgggtgccgcagctaacgcaataaacactccgcctggggagtacgcacgcaagtgtgaaactcaaaggaattgacggggacccgcacaagcagcggagcatgtggtttaattcgacgcaacgcgaagaaccttaccaagtcttgacatattacggcggggtctagagatagactcttacttcttcggaagactgtaatacaggtggtgcatggttgtcgtcagctcgtgtcgtgagatgttgggttaagtcccataacgagcgcaacccctattgttagttaccatcattaagttggggactctagcaatactgccggtgacaaaccggaggaaggtggggatgacgtcaaatcatcatgccctttatgacttgggctacacacgtgctacaatggcaggtacagagggaagcgagactgcgaagttaagcaaaactcaaaaagcctgtcccagttcggattgcactctgcaactcgagtgcatgaagttggagttgctagtaatcgcagatcagaatgctgcggtgaatgcgttcccgggtcttgtacacaccgcccgtcacaccatggaagttggcaatacccgaagcctgtgagctaacctttagggagcagcagtcgaaggtagggtcagtaactggggtgaagtcgtaacaaggtagccgtatcggaaggtgcggctggatcacctcctttct

SEQ ID NO: 148 - DNA, 1492 bp, Anaerococcus sp.
  8404299
agagtttgatcctggctcaggataaacgctggcggcgtgcataacacatgcaagtcgaacgatgaaccttaattgatttcttcggaatgaaattaagctggattagtggcgaacgggtgagtaacacgtgagtaacctgccttacacaaggggatagcctttggaaacgaagaataataccctataaagtcaaacaatatcgcatgctaragtgaccaaagatttatcggtgtaagatggacttgcgtctgattagctagttggtgagataaaagcccaccaaggcgacgatcagtagccggcttgagagagtgtacggccacattgggactgagacacggcccaaactcctacgggaggcagcagtggggaattttgcacaatgggggaaaccctgatgcagcgacgccgcgtgatttagaaggccttcgggttgtaaaaatcttttttatgggatgaaaatgacagtaccataagaataaggtccggctaaatacgtgccagcagccgcggtaatacgtatggaccgagcgttgtccggaatcattgggcgtaaagggtacgtaggcggcctagtaagttagaagtgaaataatatagctcaactatataaagcttttaaaactgttaggcttgagagatgaaagggaaagtggaattcctagtgtagcggtgaaatgcgcagatattaggaagaataccggtggcgaaggcgactttctggtcatcatctgacgctgaggtacgaaagcgtgggtagcaaacaggattagataccctggtagtccacgctgtaaacgatgagtgttaggttcttggaataatctgggagccgcagctaacgcattaaacactccgcctggggagtacgcacgcaagtgtgaaactcaaaggaattgacggggacccgcacaagcagcggagcatgtggtttaattcgacgcaacgcgaagaaccttaccaagtcttgacataatacggagggaattagagataatttcttatcacttcggtgaactgtattacaggtggtgcatggttgtcgtcagctcgtgtcgtgagatgttgggttaagtcccataacgagcgcaacccctatcgttagttaccatcattaagttggggactctagcgatactgccggtgataaaccggaggaaggtggggacgacgtcaaatcatcatgccctttatgacttgggctacacacgtgctacaatggcagatacagagggcagcgaaagagcgatctgaagcgaaactcacaaagtctgtcccagttcggattgtactctgcaactcgagtacatgaagttggagttgctagtaatcgcgaatcagaatgtcgcggtgaatgcgttcccgggtcttgtacacaccgcccgtcacaccatgggagttggcaatacccgaagcctgtgagcgaaccaattggacgcagcagtcgaaggtagggtcagtaactggggtgaagtcgtaacaaggtagccgt

SEQ ID NO: 149 - DNA, 1486 bp, Anaerococcus sp.
  8405254
tagagtttgatcctggctcaggattaacgctggcggcgtgcataacacatgcaagtcgaacgatgaaactttaatgaacccttcggggagaattaaagcggattagtggcgaacgggtgagtaacgcgtgagtaacctgccttacacaaggggatagcctttggaaacgaagaataataccctataaaaccataaaggcacatgcaattatggtcaaagtattagcggtgtaagatggacttgcgtctgattagctagttggtgagataaaagcccaccaaggcaacgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttgtataggaagaaaatgacagtactatacgaataaggtccggctaattacgtgccagcagccgcggtaatacgtaaggaccgagcgttgtccggaatcattgggcgtaaagggtacgtaggcggctagaaaagttagaagtcaaaggctatagctcaactatagtaagcttctaaaactatttagcttgagagatggaagggaaagtggaattcctagtgtagcggtggaatgcgcagatattaggaggaataccggtggcgaaggcgactttctggccattttctgacgctgaggtacgaaagcgtgggtagcaaacaggattagataccctggtagtccacgccgtaaacgatgagtgttaggtgtctggagtcaaatctgggtgccgcagcaaacgcattaaacactccgcctggggagtacgcacgcaagtgtgaaactcaaaggaattgacggggacccgcacaagcagcggagcatgtggtttaattcgacgcaacgcgaagaaccttaccaagtcttgacatattttagaagcaattagagataattgcctatatcttcggataactaaaatacaggtggtgcatggttgtcgtcagctcgtgtcgtgagatgttgggttaagtcccataacgagcgcaacccctattgctagttaccatcattaagttggggactctagtaatactgccggtgacaaaccggaggaaggtggggatgacgtcaaatcatcatgccctttatgacttgggctacacacgtgctacaatggcaggtacacagggaagcaagactgtgaagttaagcaaaactcaaaaagcctgtcccagttcggattgcactctgcaactcgagtgcatgaagttggagttgctagtaatcgcagatcagaatgctgcggtgaatgcgttcccgggtcttgtacacaccgcccgtcacaccatggaagttggcaatacccgaagcctgtgagcgaaccctttggggcgcagcagtcgaaggtagggtcagtaactggggtgaagtcgtaacaagg

SEQ ID NO: 150 - DNA, 1435 bp, Anaerococcus sp.
  9401487
tagagtttgatcctggctcaggattaacgctggcggcgtgcataacacatgcaagtcgaacgatgaaacttaaaagatttcttcggaatgaccttaagtggattagtggcggacgggtgagtaacgcgtgagtaacctgccttacacaaggggatagcctctggaaacggagaataataccctataacaccatcaaatcgcatgaagtgatggtcaaagtgttagcggtgtaagatggacttgcgtctgattagctagttggtgagaaaaaagcccaccaaggcaacgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttgtataggaagaaaatgacagtactatacgaataaggtccggctaattacgtgccagcagccgcggtaatacgtaaggaccgagcgttgtccggaatcattgggcgtaaagggtacgtaggcgggtttttaagttagaagtcaaaggctatagctcaactatagtaagcttctaaaactgggaaccttgagagatggaagggaaagtggaattcctagtgtagcggtggaatgcgcagatattaggaggaataccggtggcgaaggcgactttctggccattttctgacgctgaggtacgaaagcgtgggtagcaaacaggattagataccctggtagtccacgccgtaaacgatgagtgttaggtgtctggagtaaatctgggtgccgcagctaacgcattaaacactccgcctggggagtacgcacgcaagtgtgaaactcaaaggaattgacggggacccgcacaagcagcggagcatgtggtttaattcgaagcaacgcgaagaaccttaccaagtcttgacatattacggcagggattagagataatcccctacatcttcggatgactgtaatacaggtggtgcatggttgtcgtcagctcgtgtcgtgagatgttgggttaagtcccataacgagcgcaaccccttttgctagttaccatcattaagttggggactctagcaatactgccggtgacaaaccggaggaaggtggggatgacgtcaaatcatcatgccctttatgacttgggctacacacgtgctacaatggcaggtacacagggcagcaagacagtgatgttaagcgaaactcaaaaagcctgtcccagttcggattgcactctgcaactcgagtgcatgaagttggagttgctagtaatcgtggatcagaatgccgcggtgaatgcgttcccgggtcttgtacacaccgcccgtcacaccatggaagttggcaatacccgaagcctgtgagctaaccctttggg

SEQ ID NO: 151 - DNA, 1289 bp, Anaerococcus sp.
  9403502
aagtaatcaaagtgttttagcggtgtaagatggacttgcgtctgattagctagttggtgagataacagctcaccaaggcaacgatcagtagccggcttgagagagtgtacggccacattgggactgagacacggcccagactcctacgggaggcagcagtggggaattttgcacaatgggggcaaccctgatgcagcgacgccgcgtgatttatgaaggccttcgggttgtaaaaatcttttgtataggaagaagatgacagtactatacgaataaggtccggctaattacgtgccagcagccgcggtaatacgtaaggaccgagcgttgtccggaatcattgggcgtaaagggtacgtaggcggccamttaagttagaagtcaaaggctatagctcaactatagtaagcttctaaaactgggtggcttgagagatggaagggaaagtggaattcctagtgtagcggtgaaatgcgcagatattaggaggaataccggtggcgaaggcgactttctggccattatctgacgctgaggtacgaaagcgtgggtagcaaacaggattagataccctggtagtccacgccgtaaacgatgagtgttaggtgtctggagtaaatctgggtgccgcagctaacgcattaaacactccgcctggggagtacgcacgcaagtgtgaaactcaaaggaattgacggggacccgcacaagcagcggagcatgtggtttaattcgaagcaacgcgaaaaaccttaccaagtcttgacatattacggcgtttcttagagataagaagctatatcttcggataactgtaatacaggtggtgcatggttgtcgtcagctcgtgtcgtgagatgttgggttaagtcccataacgagcgcaacccttatggctagttaccatcattaagttggggactctagcaatactgccggtgacaaaccggaggaaggtggggatgacgtcaaatcatcatgccctttatgacttgggctacacacgtgctacaatggcaggtacagagggcagcgaaactgygaagttaagcgaaactcaaaaagcctgtcccagttcggattgcactctgcaactcgagtgcatgaagttggagttgctagtaatcgcagatcagaatgctgcggtgaatgcgttcccgggtcttgtacacaccgcccgtcacaccatggaagttggcaatacccgaagcctgtgagcgaaccctttgggacgcagcagtcgaaggtagggtcagtaactggggtgaagtcgtaacaaggtagccgta

SEQ ID NO: 152 - DNA, 1445 bp, Anaerococcus sp.
  gpac104
gattaacgctggcggcgtgcataacacatgcaagtggaacgatgaaacttgaatgatctcttcggagtgaacttaagtggattagtggcggacgggtgagtaacgcgtgagtaacctgccttagagaaggggatagcctttggaaacgaagaataataccctatgacatgatagcctcgcatgagattatcrtcaaagatttatcgctctaagatggacttgcgtctgattagttagttggtggggtaacggcccaccaagacagcgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttctatgggaagaacatgacagtaccataggaataaggaccggctaattacgtgccagcagccgcggtaatacgtaaggtccgagcgttgtccggaatcattgggcgtaaagggtacgtaggcgggtaagcaagttagaagtgaaatcctatagctcaactatagtaagcttttaaaactgctcatcttgaggtatggaagggaaagtggaattcctagtgtagcggtgaaatgcgcagatattaggaggataccggtggcgaaggcgactttctggcataacctgacgctgaggtacgaaagcgtgggtagcaaacaggattagataccctggtagtccacgccgtaaacgatgagtgttaggtgtctggagtaaatctgggtgccgcagtaacgcattaaacactccgcctggggagtacgcgcgcaagcgtgaaactcaaaggaattgacgggacccgcacaagcagcggagcatgtggtttaattcgacgcaacgcgaagaaccttaccaagtcttgacatattacggcgggagctagagatagttccttacttcttcggaagactgtaatacaggtggtgcatggttgtcgtcagctcgtgtcgtgagatgttgggttaagtcccataacgagcgcaacccctattgttagttaccatcattaagttggggactctaacgatactgccggtgacaaaccggaggaaggtggggacgacgtcaaatcatcatgccctttatgacttgggctacacacgtgctacaatggcaggtacacagagcagctaaacagtgatgtcttgcgaatctcaaaaagcctgtcccagttcggattgtactctgcaactcgagtacatgaagttggagttgctagtaatcgtgaatcagaatgtcgcggtgaatgcgttcccgggtcttgtacacaccgcccgtcacaccatggaagttggcaatgcccgaagcctgtgagcgaacccttgtgggcgcagcagtcgaaggtagggtcagtaactgggtg

SEQ ID NO: 153 - DNA, 1450 bp, Anaerococcus sp.
  gpac126
  modified_base (842)..(842): a, c, t, g, unknown or other
gattaacgctggcggcgtgcataacacatgcaagtcgaacgatgaaagctaaatgatttcttcggaatgaatttagccggattagtggcggacgggtgagtaacgcgtgagtaacctgccttagagaaggggatagcctttggaaacgaagaataataccctatgacaccaacacctcgcatgaagagttggtcaaagatttatcgctctaagatggacttgcgtctgattagttagttggtgaggtaacggctcaccaagacagcgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttctatgggaagaaaatgacagtaccataggaataaggaccggctaattacgtgccagcagccgcggtaatacgtaaggtccgagcgttgtccggaatcattgggcgtaaagggtacgtaggcgggtaagcaagttagaagtgaaatcctatagctcaactatagtaagcttttaaaactgctcatcttgaggtatggaagggaaagtggattcctagtgtagcggtgaaatgcgcagatattaggggggataccggtggcgaaggcgactttctggcataacctgacgctgaggtacgaaagcgtgggtagcaaacagggttagataccyggkagtccacgccgtaaacgawgagtgataggtgtctggagaaaatctgggtgccgcagtaacgcatwaaacactccsccctggggantacgcgcgcaagcgtgaaactcaaaggaattgacggggacccgcacaagcagcggagcatgtggtttaattcgacgcaacgcgaagaacctttaccaagtctagacatattaccggcgggatctagagatagatccctacttcttcggaagactgtaatacaggtggtgcatgtttgtcgtcagctcgtgtcgtgagatgttgggttaagtcccataagcgagcgcaacccctattgttagttaccatcattaagttggggactctaacgatactgccgttgacaaaccggagaaagttggggacgacgtcaaatcatcatgccctttatgacttgggctacacacgtgctacaatggcaggtacacagagcagctagacagcgatgtcatgcaaatctcaaaaagcctgtccccagttcggattgtactctgcaactcgagtacatgaagttggagttgctagtaatcgtggatcagaatgccgcggtgaatgcgttcccgggtcttgtacacaccgcccgtcacaccatggaagttggcaatacccgaagcctgtgagcgaacccttgtggaagcagcagtcgaaggtagggtcagtaactgggtg

SEQ ID NO: 154 - DNA, 1440 bp, Anaerococcus sp.
  gpac155
  modified_base (1373)..(1373): a, c, t, g, unknown or other
  modified_base (1395)..(1397): a, c, t, g, unknown or other
  modified_base (1401)..(1401): a, c, t, g, unknown or other
gattaacgctggcggcgttcataacacatgcaagtcgaacgatgaaacttaaatgatctcttcggagtgaatttaagtggattagtggcggacgggtgagtaacgcgtgagtaacctgccttagagaaggggatagcctttggaaacgaagaataataccctatgaaaccataacctcgcatgaggccttggtcaaagatttatcgctctaagatggacttgcgtctgattagttagttggtggggtaacggcccaccaagacagcgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttctatgggaagaaaatgacagtaccataggaataaggaccggctaattacgtgccagcagccgcggtaatacgtaaggtccgagcgttgtccggaatcattgggcgtaaagggtacgtaggcgggtaagcaagttagaagtgaaatcctatagctcaactatagtaagcttttaaaactgctcatcttgaggtatggaagggaaagtggaattcctagtgtagcggtgaaatgcgcagatattaggaggaataccggtggcgaaggcgactttctggccataccctgacgctgaggtacgaaagcgtgggtagcaaaccaggattagataccctggtagtccacgccgtaaacgatgagtgttaggtgtctggagtaaatctgggtgccgcagctaacgcattaaacactccgccctggggagtacgcgcgcaagcgtgaaactcaaaggaattgacggggacccgcacaagcagcggagcatgtggtttaattcgacgcaacgcgaagaaccttaccaagtcttgacatattacggcggaacttagagataagttcttatgacttcggtcaactgtaatacaggtggtgcatggttgtcgtcagctcgtgtcgtgagatgttgggttaagtcccataacgagcgcaacccctattgttagttaccatcattaagttggggactctaacgatactgccggtgacaaaccggaggaaggtggggacgacgtcaaatcatcatgccctttatgacttgggctacacacgtgctacaatggcaggtacacagagcagctaaacagtgatgtcttgcgaatctcaaaaagcctgtcccagttcggattgtactctgcaactcgagtacatgaagttggagttgctagtaatcgtgaatcagaatgtcgcggtgaatgcgttcccggtcttgtacacacgccgtcacaccatgnagttgcatacccgagcctgtgnnncccngtgggcgccgcagtcgaaggtaggtcagtaactggggtg

SEQ ID NO: 155 - DNA, 1457 bp, Anaerococcus sp.
  gpac199
gattaacgctggcggcgtgcataacacatgcaagtggaacgatgaaacttttttgatttcttcggaatgaatataagtggattagtggcggacgggtgagtaacgcgtgagtaacctgccttagagaaggggatagcctttggaaacgaagaataataccctatgaaaccataacctcgcatgaggccttggtcaaagatttatcgctctaagatggacttgcgtctgattagttagttggtggggtaacggcctaccaagacagcgatcagtagccggcttgagagagtgtacggccacattgggactgagacacggcccagactcctacgggaggcagcagtggggaattttgcacaatgggggaaaccctgatgcagcgacgccgcgtgatttagaaggccttcggggttgtaaaaatcttttctatgggaagaaaatgacagtaccatagggaataagggaccgggctaattacgtgccagcagccgcgggtaatacgtaaggtccgcagcgttgtccggaatcattgggcgtaaagggtacgtaggcgggtaagcaagttagaagtgaaatcctatagctcaactatagtaagcttttaaaactgctcatcttgaggtatggaagggaaagtgggattcctagtgtagcggtgaaatgcgcagatattaggaggataccgggtggcgaaggcgactttctgccaataccctgacgctgaggtacgaaagcgtggtagcaaaccaggattagataccctggtagtccacgccgtaaacgatgagtgttaggtgtctggagtaaatctgggtgccgcagctaacgcattaaacactccgcctggggagtacgcgcgcaagcgtgaaactcaaaggaattgacggggacccgcacaagcagcggagcatgtgtttaattcgacgcaacgcgaagaaccttaccaagtcttgacatattacggcggaacttagagataagttcttatgacttcggtcaactgtaatacaggtggtgcatggttgtcgtcagctcgtgtcgtgagatgttgggttaagtcccataacgagcgcaacccctattgttagttaccatcattaagttggggactctaacgatactgccggtgacaaaccggaggaaggtggggacgacgtcaaatcatcatgccctttatgatcttgggctacacacgtgctacaatggcaggtacacagagcagctaaacagtgatgtcttgcgaatctcaaaaagcctgtcccagttcggattgtactctgcaactcgagtacatgaagttggagttgctagtaatcgtgaatcagaatgtcgcggtgaatgcgttccccgggtcttgtacacaccgcccgtcacaccatggaagttggcaatacccgaagccctgtgagcgaacccaattgggcgcagcagtcgaaggtaggtcagtaactggggtg

SEQ ID NO: 156 - DNA, 1458 bp, Anaerococcus sp.
  gpac215
  modified_base (13)..(13): a, c, t, g, unknown or other
  modified_base (737)..(737): a, c, t, g, unknown or other
  modified_base (741)..(741): a, c, t, g, unknown or other
  modified_base (761)..(761): a, c, t, g, unknown or other
taacgctggcggncgtgcataacacatgcaagtcgaacgatgaaacttaaatgatttcttcggaatgaacttaagcggattagtggcgaacgggtgagtaacacgtgagtaacctgccttacacaaggggatagcctttggaaacgaagaataataccctataacgtcaaattatcgcatgatagaatgaccaaagatttatcggtgtaagatggacttgcgtctgattagctagttggtgagataaaggcccaccaaggcaacgatcagtagccggctttgagagagtgtacggccacattgggactgagacacggcccaaactcctacgggaggcagcagtggggaattttgcacaatgggggaaaccctgatgcagcgacgccgcgtgatttagaaggccttcgggttgtaaaaatcttttttatgggatgaaaatgacagtaccataagaataaggtccggctaaatacgtgccagcagccgcggtaatacgtatggaccgagcgttgtccggaatcattgggcgtaaagggtacgtaggcggcccagtaagttagaagtgaaataatatagctcaactatataaagcttttaaaactgctaggcttgagagatggaagggaaagtggaattcctagtgtagcggtgaaatgcgcagatattaggaagaataccggtgccgaagcgactttctggtcatcatctggacgttgaggtacgaaagcgttggttancaanccaggattagatacccctgntagtccacggcctgtaaacgatgagtgttagttcttggaataatctgggagccgcagctaacgcattaaacactccgcctggggagtacgcacgcaagtgtgaaactcaaaggaattgacggggacccgcacaagcagcggagcatgtggtttaattcgacgcaacgcgaagaaccttaccaagtcttgacataatacggagggaattagagatagtttcttaagacttcggtctactgtattacaggtggtgcatggttgtcgtcagctcgtgtcgtgagatgttgggttaagtcccataacgagcgcaacccctatcgttagttaccatcattaagttggggactctagcgatactgccggtgataaaccggaggaaggtggggacgacgtcaaatcatcaatgccccttttaatggaaccttgggctacacacgtgctacaatggcaggtacagagggcagcgaaagagcgatctgaagcgaaactcaaaaaacctgtcccagttcggattgtactctgcaactcgagtacatgaagttggagttgctagtaatcgcgaatcagaatgtcgcggtgaatgcgttcccgggtcttgtacacaccgcccgtcacaccatgggagttggcaatacccgaagcctgtgagcgaccttttaggacgcagcagtcgaaggtaggatcagtaagctgggtg

SEQ ID NO: 157 - DNA, 1530 bp, Anaerococcus tetradius
ttatatatgagagtttgatcctggctcaggattaacgctggcggcgtgcataacacatgcaagtcgaacgatgaagatatttagattccttcgggatgaaaaatattggattagtggcggacgggtgagtaacgcgtgagtaacctgccttacacaaggggatagccgttggaaacgacgaataataccctatgacataaactcttcgcatgaagagcttatcaaagatttatcggtgtaagatggactcgcgtctgattagctagttggtgaggtaacggcccaccaaggcaacgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttgtatgggaagaaaatgacagtaccatacgaataaggaccggctaattacgtgccagcagccgcggtaatacgtaaggtccgagcgttgtccggaatcattgggcgtaaagggtacgtaggcggataagcaagttagaagtgaaatcctatagctcaactatagtaagcttttaaaactgctcatcttgaggtatggaagggaaagtggaattcctagtgtagcggtgaaatgcgcagatattaggaggaataccggtggcgaaggcgactttctggccataaactgacgctgaggtacgaaagcgtgggtagcaaacaggattagataccctggtagtccacgccgtaaacgatgagtgttaggtgtctggaataatctgggtgccgcagctaacgcaataaacactccgcctggggagtacgcacgcaagtgtgaaactcaaaggaattgacggggacccgcacaagcagcggagcatgtggtttaattcgacgcaacgcgaagaaccttaccaagtcttgacatattacggagggaattagagatagttccttacttcttcggaagactgtaatacaggtggtgcatggttgtcgtcagctcgtgtcgtgagatgttgggttaagtcccataacgagcgcaacccctatatttagttaccatcattaagttggggactctagatatactgccggtgataaaccggaggaaggtggggatgacgtcaaatcatcatgccctttatgacttgggctacacacgtgctacaatggcaggtacacagggaagcgagactgcgaagttaagcaaaactcaaaaagcctgtcccagttcggattgcactctgcaactcgagtgcatgaagttggagttgctagtaatcgtggatcagaatgccgcggtgaatgcgttcccgggtcttgtacacaccgcccgtcacaccatggaagttggcaatacccgaagcctgtgagctaaccattaggaagcagcagtcgaaggtagggtcagtaactggggtgaagtcgtaacaaggtagccgtatcggaaggtgcggctggatcacctcctttct

SEQ ID NO: 158 - DNA, 1425 bp, Anaerococcus vaginalis
tggattagtggcgaacgggtgagtaacacgtgagtaacctgccttacacaaggggatagcctttggaaacgaagaataataccctataaagtcaaaatatcgcatgataaaatgaccaaagatttatcggtgtaagatggacttgcgtctgattagctagttggtgagataaaagcccaccaaggcgacgatcagtagccggcttgagagagtgtacggccacattgggactgagacacggcccaaactcctacgggaggcagcagtggggaattttgcacaatgggggaaaccctgatgcagcgacgccgcgtgatttagaaggccttcgggttgtaaaaatcttttttatgggatgaaaatgacagtaccataagaataaggtccggctaaatacgtgccagcagccgcggtaatacgtatggaccgagcgttgtccggaatcattgggcgtaaagggtacgtaggcggcctagtaagttagaagtgaaataatatagctcaactatataaagcttttaaaactgttaggcttgagagatgaaagggaaagtggaattcctagtgtagcggtgaaatgcgcagatattaggaagaataccggtggcgaaggcgactttctggtcatcatctgacgctgaggtacgaaagcgtgggtagcaaacaggattagataccctggtagtccacgctgtaaacgatgagtgttaggttcttggaataatctgggagccgcagctaacgcattaaacactccgcctggggagtacgcacgcaagtgtgaaactcaaaggaattgacggggacccgcacaagcagcggagcatgtggtttaattcgacgcaacgcgaagaaccttaccaagtcttgacataatacggagggaattagagataattttctatgacttcggtctactgtattacaggtggtgcatggttgtcgtcagctcgtgtcgtgagatgttgggttaagtcccataacgagcgcaacccctatcgttagttaccatcattaagttggggactctagcgatactgccggtgataaaccggaggaaggtggggacgacgtcaaatcatcatgccctttatgacttgggctacacacgtgctacaatggcagatacagagggcagcgaaagagcgatctgaagcgaaactcacaaagtctgtcccagttcggattgtactctgcaactcgagtacatgaagttggagttgctagtaatcgcgaatcagaatgtcgcggtgaatgcgttcccgggtcttgtacacaccgcccgtcacaccatgggagttggcaatacccgaagcctgtgagcgaaccttttaggacgcagcagtcgaaggtagggtcagtaactggggtgaagtcgtaacaaggtagccgtatcggaaggtgcggctggatcacctcctttct

SEQ ID NO: 159 - DNA, 1035 bp, Anaerofustis stercorihominis
  modified_base (868)..(868): a, c, t, g, unknown or other
  modified_base (940)..(941): a, c, t, g, unknown or other
  modified_base (956)..(956): a, c, t, g, unknown or other
  modified_base (1004)..(1004): a, c, t, g, unknown or other
  modified_base (1020)..(1021): a, c, t, g, unknown or other
gtcgaacgagaagcttacaattgatccttcgggtgaagctgtaagtggacagtggcgaacgggtgagtaacgcgtaggtaaccaacctcatgcagggggatagcccagggaaacttggattaaacccgcataagaccacagcaccgcatggtgcagaggtaaaaactccggtggcatgagacggacctgcgtcttattaggtagttggtgaggtaacggctcaccaagccaacgatgagtagccgacctgagagggtgatcggccacattgggactgagacacggcccagactcctacgggaggcagcagtggggaatattgcgcaatggggggaaccctgacgcagcaacgccgcgtgagcgatgaaggttttcggatcgtaaagctctgtctttggggaagataatgacggtacccaaggaggaagctccggctaactacgtgccagcagccgcggtaatacgtagggagcaagcgttgtccggattcactgggcgtaaagagcacgtaggcggttaattaagtcaggtgtgaaagttttcggctcaaccggaaaagtgcacttgaaactgaataacttgagtatcggagaggtaagcggaattcctagtgtagcggtgaaatgcgtagagattaggaagaacaccggtggcgaaggcggcttactggacgataactgacgctgaggtgcgaaagcgtggggagcgaacaggattagataccctggtagtccacgccgtaaacgatgaatactaggtgttggggtaactcagtgccgcagttaacacattaagtattccgcctggggagtacgctcgcaagagtgaaactcaaaggaattgacgggggcccgcacaagcagcggancatgtggtttaattcgaagcaacgcgaagaaccttaccaggtcttgacatcccttgaccgcctaagagattnnctttccttcgggacnaggagacaggtggtgcatggttgtcgtcagctcgtgtcgtgagatgtngggttaagtcccgcannagcgcaacccttat

SEQ ID NO: 160 - DNA, 1316 bp, Anaeroglobus geminatus
agagtttgatcctggctcaggacaacgctggcggcgtgcgtaacacatgcaagtcgaacgagagagtgagagaagcttgcttttcttacaatcgagtggcaaacgggtgagtaacgcgtaaacaacctgccccgcagatggggacaacagctggaaacggctgctaataccgaatacggtcctcttagcgcatggtaagaggaagaaagggtggcctctggaacaagctaccgctgtgggaggggtttgcgtctgattagctggttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttataggggacgaacggccgggtagcgaagagggagccggcatgacggtaccgtaagagaaagccacggctaactacgtgccagcagccgcggtaatacgtaggtggcaagcgttgtccggaatgattgggcgtaaagggcgcttggcggctgtgtaagtctgtctagaaagtgcggggctaaaccccgtgagaggatggaaactggacagctgagagtgtcggagaggaaagcggaattcctagtgtagcggtgaaatgcgtagatattaggaggaacaccggtggcgaaagcggctttctggacgacaactgacgctgaggcgcgaaagccaggggagcaaacgggattagataccccggtagtcctggccgtaaacgatgggtactaggtgtaggaggtatcgacccctcctgtgccggagttaacgcaataagtaccccgcctggggagtacggccgcaaggctgaaactcaaaggaattgacgggggcccgcacaagcggtggagtatgtggtttaattcgacgcaacgcgaagaaccttaccaagccttgacattgctcgcaacgggtagagatacctggttcttcttcggaagacgagacaacaggtggtgcacggctgtcgtcagctcgtgtcgtgagatgttgggttaagtcccgcaacgagcgcaacccctatcttcagttaccagcacgtagaggtggggactcaggagagactgccgcagacaatgcggaggaaggcggggacgacgtcaagtcatcatgccccttatggcttgggctacacacgtactacaatggctctaaatagagggaagcgaaggagcgatccggagcaaaccccgcaaacagagtccc

SEQ ID NO: 161 - DNA, 1390 bp, Anaerosporobacter mobilis
ggcggcgtgcttaacacatgcaagtcgaacgaagcaactatcttgcttgcaagagagttgacttagtggcggacgggtgagtaacgcgtgggtaacctgcctcatacagggggataacagttggaaacgactgctaagaccgcataacccgctagtgtcgcatgacacggacggaaaatatttataggtatgagatgggcccgcgtctgattagctagttggtaaggtaacggcttaccaaggcgacgatcagtagccgacttgagagagtgatcggccacattgggactgagacacggcccaaactcctacgggaggcagcagtggggaatattggacaatgggggaaaccctgatccagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtaggtggcatggcaagtcagaagtgaaagcccagggctcaaccctgggactgcttttgaaactgtcaagctagagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgtctgggattcgattctcaggtgccgacgctaacgcattaagtattccacctggggagtacgttcgcaagaatgaaactcaaaggaattgacggggacccgcacaagcggtggagcatgtggtttaattcgaagcaacgcgaagaaccttacctagtcttgacatcccgatgaccggactttaatcggtccttctcttcggagcatcggagacaggtggtgcatggttgtcgtcagctcgtgtcgtgagatgttgggttaagtcccgcaacgagcgcaacccctatctttagtagccagcatttaaggtgggcactctagagagactgccagggataacctggaggaaggtggggatgacgtcaaatcatcatgccccttatgactagggctacacacgtgctacaatggtgataacaaagtgaagcagcctcgtgagagtgagcaaatcacaaaaatgtcatctcagttcggattgtagtctgcaactcgactacatgaagctggaatcgctagtaatcgcgaatcagaatgtcgcggtgaatacgttcccgggtcttgtacacaccgcccgtcacaccatgggagttggtaatgcccgaagtcagtgacccaacc

SEQ ID NO: 162 - DNA, 1539 bp, Anaerostipes caccae
ttgaacatgagagtttgatcctggctcaggatgaacgctggcggcgtgcttaacacatgcaagtcgaacgaagcatttaggattgaagttttcggatggatttcctatatgactgagtggcggacgggtgagtaacgcgtggggaacctgccctatacaggggggataacagctggaaacggctgctaataccgcataagcgcacagaatcgcatgattcagtgtgaaaagccctggcagtataggatggtcccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaacagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatcccaatgagcgaaccttaaccggttttttctttcgagacattggagacaggtggtgcatggttgtcgtcagctcgtgtcgtgagatgttgggttaagtcccgcaacgagcgcaacccctatctttagtagccagcatttaaggtgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctcctttct

SEQ ID NO: 163 - DNA, 1344 bp, Anaerostipes sp.
  3_2_56FAA
  modified_base (25)..(25): a, c, t, g, unknown or other
  modified_base (44)..(44): a, c, t, g, unknown or other
cggatggatttcctatatgactgantggcggacgggtgagtaangcgtggggaacctgccctatacagggggataacagctggaaacggctgctaataccgcataagcgcacagaatcgcatgattcagtgtgaaaagccctggcagtataggatggtcccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaacagacggtacctgactaagaagccccggctaactacgtgcagcccggtaacgggggcaagcgttatcggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatcccaatgaccgaaccttaaccggttttttctttcgagacattggagacaggtggtgcatggttgtcgtcagctcgtgtcgtgagatgttgggttaagtcccgcaacgagcgcaacccctatctttagtagccagcattacggatgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccgcaa

SEQ ID NO: 164 - DNA, 1360 bp, Anaerotruncus colihominis
cttacgttttgaagttttcggatggatgaatgtaagcttagtggcggacgggtgagtaacacgtgagcaacctgcctttcagagggggataacagccggaaacggctgctaataccgcatgatgttgcgggggcacatgcccctgcaaccaaaggagcaatccgctgaaagatgggctcgcgtccgattagccagttggcggggtaacggcccaccaaagcgacgatcggtagccggactgagaggttgaacggccacattgggactgagacacggcccagactcctacgggaggcagcagtgggggatattgcacaatgggcgaaagcctgatgcagcgacgccgcgtgagggaagacggtcttcggattgtaaacctctgtctttggggaagaaaatgacggtacccaaagaggaagctccggctaactacgtgccagcagcgcggtaatacgtagggagcaagcgttgtccggaattactgggtgtaaagggagcgtaggcgggatggcaagtagaatgttaaatccatcggtcaaccggtggctgcgttctaaactgccgttcttgagtgaagtagaggcaggcggaattcctagtgtagcggtgaaatgcgtagatattaggaggaacaccagtggcgaaggcggcctgctgggctttaactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcggatgcatagcctagagataggtgaagcccttcggggcatccagaaaggtggtgcatgagtgtcgtcagctcgtgtcgtgagatgttgggttaagtcccgcaacgagcgcaacccttattattagttgctacgcaagagcactctaatgagactgccgttgacaaaacggaggaaggtggggatgacgtcaaatcatcatgccccttatgacctgggctacacacgtactacaatggcactaaaacagagggcggcgacaccgcgaggtgaagcgaatcccgaaaaagtgtctcagttcagattgcaggctgcaacccgcctgcatgaagtcggaattgctagtaatcgcggatcagcatgccgcggtgaatacgttcccgggccttgtacacaccgcccgtcacaccatgggagtcggtaacacccgaagccagtagcctaaccg

SEQ ID NO: 165 - DNA, 1505 bp, Anaplasma marginale
tcaaacttgagagtttgatcctggctcagaacgaacgctggcggcaagcttaacacatgcaagtcgaacggaccgtatacgcagcttgctgcgtgtatggttagtggcagacgggtgagtaatgcataggaatctacctagtagtatgggatagccactagaaatggtgggtaatactgtataatccctgcgggggaaagatttatcgctattagatgagcctatgtcagattagctagttggtggggtaatggcctaccaaggcggtgatctgtagctggtctgagaggatgatcagccacactggaactgagacacggtccagactcctacgggaggcagcagtggggaatattggacaatgggcgcaagcctgatccagctatgccgcgtgagtgaggaaggccttagggttgtaaaactctttcagtagggaagataatgacggtacctacagaagaagtcccggcaaactccgtgccagcagccgcggtaatacggagggggcaagcgttgttcggaattattgggcgtaaagggcatgtaggcggtttggtaagttaaaggtgaaataccagggcttaaccctggggctgcttttaatactgcaggactagagtccggaagaggatagcggaattcctagtgtagaggtgaaattcgtagatattaggaggaacaccagtggcgaaggcggctgtctggtccggtactgacgctgaggtgcgaaagcgtggggagcaaacaggattagataccctggtagtccacgctgtaaacgatgagtgctgaatgtgggggcttttgcctctgtgttgtagctaacgcgttaagcactccgcctggggactacggtcgcaagactaaaactcaaaggaattgacggggacccgcacaagcggtggagcatgtggtttaattcgatgcaacgcgaaaaaccttaccacttcttgacatggaggctagatccttcttaacagaagggcgcagttcggctgggcctcgcacaggtgctgcatggctgtcgtcagctcgtgtcgtgagatgttgggttaagtcccgcaacgagcgcaaccctcatccttagttaccagcgggtaatgccgggcactttaaggaaactgccagtgataaactggaggaaggtggggatgatgtcaagtcagcacggcccttatggggtgggctacacacgtgctacaatggcgactacaataggttgcaacgtcgcaaggctgagctaatccgtaaaagtcgtctcagttcggattgtcctctgtaactcgagggcatgaagtcggaatcgctagtaatcgtggatcagcatgccacggtgaatacgttctcgggtcttgtacacactgcccgtcacgccatgggaattggcttaactcgaagctggtgcgccaaccgtaaggaggcagccatttaaggttgggtcggtgactggggtgaagtcgtaacaaggtagctgtaggtgaacctgcggctggattacctccttt

SEQ ID NO: 166 - DNA, 1508 bp, Anaplasma phagocytophilum
tcaaacttgagagtttgatcctggctcagaacgaacgctggcggcaagcttaacacatgcaagtcgaacggattattctttatagcttgctataaagaatagttagtggcagacgggtgagtaatgcataggaatctacctagtagtatgggatagccactagaaatggtgggtaatactgtataatccctgcgggggaaagatttatcgctattagatgagcctatgttagattagctagttggtagggtaaaggcctaccaaggcgatgatctatagctggtctgagaggatgatcagccacactggaactgagatacggtccagactcctacgggaggcagcagtggggaatattggacaatgggcgcaagcctgatccagctatgccgcgtgagtgaggaaggccttagggttgtaaaactctttcagtagggaagataatgacggtacctacagaagaagtcccggcaaactccgtgccagcagccgcggtaatacggagggggcaagcgttgttcggaattattgggcgtaaagggcatgtaggcggttcggtaagttaaaggtgaaatgccagggcttaaccctggagctgcttttaatactgccagactagagtccgggagaggatagcggaattcctagtgtagaggtgaaattcgtagatattaggaggaacaccagtggcgaaggcggctatctggtccggtactgacgctgaggtgcgaaagcgtggggagcaaacaggattagataccctggtagtccacgctgtaaacgatgagtgctgaatgtggggattttttatctctgtgttgtagctaacgcgttaagcactccgcctggggactacggtcgcaagactaaaactcaaaggaattgacggggacccgcacaagcggtggagcatgtggtttaattcgatgcaacgcgaaaaaccttaccactccttgacatggagattagatccttcttaacggaagggcgcagttcggctggatctcgcacaggtgctgcatggctgtcgtcagctcgtgtcgtgagatgttgggttaagtcccgcaacgagcgtaaccctcatccttagttgccagcgggttaagccgggcactttaaggaaactgccagtggtaaactggaggaaggtggggatgatgtcaagtcagcacggcccttatggggtgggctacacacgtgctacaatggtgactacaataggttgcaatgtcgcaaggctgagctaatccgtaaaagtcatctcagttcggattgtcctctgcaactcgagggcatgaagtcggaatcgctagtaatcgtggatcagcatgccacggtgaatacgttctcgggtcttgtacacactgcccgtcacgccatgggaattggcttaactcgaagctggtgcgccaaccgaaaggaggcagccatttaaggttgggtcagtgactagggtgaagtcgtaacaaggtagctgtaggtgaacctgcggctggattacctccttt

SEQ ID NO: 167 - DNA, 1393 bp, Aneurinibacillus aneurinilyticus
gtcgagcggaccaaagaagagcttgctcttcggcggttagcggcggacgggtgagtaacacgtaggcaacctgcctgtacgactgggataactccgggaaaccggagctaataccggatacgtttttcagaccgcatggtctgaaagagaaagacctttggtcacgtacagatgggcctgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaaccgccgggatgacctcccggtctgacggtacctaacgagaaagccccggctaactacgtgccagcagccgcggtaatacgtagggggcaagcgttgtccggaattattgggcgtaaagcgcgcgcaggcggcttcttaagtcaggtgtgaaagcccacggtcaaccgtggagggccacttgaaactgggaggcttgagtgcaggagaggagagcggaattccacgtgtagcggtgaaatgcgtagagatgtggaggaacacccgtggcgaaggcggctctctggcctgtaactgacgctgagcgcgaaagcgtggggagcgaacaggattagataccctggtagtccacgccgtaaacgttgagtgctaggtgttggggactccaatcctcagtgccgcagctaacgcaataagcactccgcctggggagtacggccgcaaggctgaaactcaaaggaattgacggggacccgcacaagcggtggagcatgtggtttaattcgaagcaacgcgaagaaccttaccagggcttgacatcccgctgaccctcctagagataggagctctcttcggagcagcggtgacaggtggtgcatggttgtcgtcagctcgtgtcgtgagatgttgggttaagtcccgcaacgagcgcaacccttgtccttagttgccagcattcagttgggcactctagggagactgccgtcgacaagacggaggaaggtggggatgacgtcaaatcatcatgccccttatgtcctgggctacacacgtgctacaatggatggaacaacgggcagccaactcgcgagagtgcgccaatcccttaaaaccattctcagttcggattgcaggctgcaactcgcctgcatgaagccggaatcgctagtaatcgcggatcagcatgccgcggtgaatacgttcccgggtcttgtacacaccgcccgtcacaccacgagagtttgcaacacccgaagtcggtgaggtaaccgcaaggagc

SEQ ID NO: 168 - DNA, 1417 bp, Aneurinibacillus danicus
  modified_base (809)..(809): a, c, t, g, unknown or other
  modified_base (1245)..(1245): a, c, t, g, unknown or other
cgaacgctggcggcgtgcctaatacatgcaagtcgagcggaccaacggagagcttgctctcctgcggtcagcggcggacgggtgagtaacacgtaggcaacctgcctgtacgaccgggataactccgggaaaccggagctaataccggataggatttcagaccgcatggtttggaatggaaagaccctgtgtcacgtacagatgggcctgcggcgcattagctagttggtggggtaacggcctaccaaggcgacgatgcgtagccgacctgagagggtgaacggccacactgggactgagacacggcccagactcctacgggaggcagcagtagggaatcttccgcaatggacgaaagtctgacggagcaacgccgcgtgaacgaagaaggttttcggatcgtaaagttctgttgttagggaagaaccgccgggataacctcccggtctgacggtacctaacgagaaagccccggctaactacgtgccagcagccgcggtaatacgtagggggcaagcgttgtccggaattattgggcgtaaagcgcgcgcaggcggcttcttaagtcaggtgtgaaagcccacggctcaaccgtggagggccacttgaaactgggaggcttgagtgcaggagaggagagcggaattccacgtgtagcggtgaaatgcgtagagatgtggaggaacacctgtggcgaaggcggctctctggcctgtaactgacgctgaggcgcgaaagcgtggggagcgaacaggattagataccctggtagtccacgccgtaaacgatgagtgctaggtgttggggtntccaaacctcagtgccgcagctaacgcaataagcactccgcctggggagtacggccgcaaggctgaaactcaaaggaattgacggggacccgcacaagcggtggagcatgtggtttaattcgaagcaacgcgaagaaccttaccagggcttgacatcccgctgacccctctagagatagaggcttccttcgggacagcggtgacaggtggtgcatggttgtcgtcagctcgtgtcgtgagatgttgggttaagtcccgcaacgagcgcaacccttgtccttagttgccagcattcagttgggcactctagggagactgccgtcgacaagacggaggaaggtggggatgacgtcaaatcatcatgccccttatgtcctgggctacacacgtgctacaatggatggaacaacgggcagccaactcgcgagagtgagcnaatcccttaaaaccattctcagttcggattgcaggctgcaactcgcctgcatgaagccggaatcgctagtaatcgcggatcagcatgccgcggtgaatacgttcccgggtcttgtacacaccgcccgtcacaccacgagagtttgcaacacccgaagtcggtgaggtaacct

SEQ ID NO: 169 - DNA, 1483 bp, Aneurinibacillus migulanus
aggacgaacgctggcggcgtgcctaatacatgcaagtcgagcggaccaatgaagagcttgctcttcggcggttagcggcggacgggtgagtaacacgtaggcaacctgcctgtacgactgggataactccgggaaaccggagctaataccggatacttctttcagaccgcatggtctgaaagagaaagacctttggtcacgtacagatgggcctgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaaccgccgggatgacctcccggtctgacggtacctaacgagaaagccccggctaactacgtgccagcagccgcggtaatacgtagggggcaagcgttgtccggaattattgggcgtaaagcgcgcgcaggcggcttcttaagtcaggtgtgaaagcccacggctcaaccgtggagggccacttgaaactgggaagcttgagtgcaggagaggagagcggaattccacgtgtagcggtgaaatgcgtagagatgtggaggaacacccgtggcgaaggcggctctctggcctgtaactgacgctgaggcgcgaaagcgtggggagcgaacaggattagataccctggtagtccacgccgtaaacgttgagtgctaggtgttggggactccaatcctcagtgccgcagctaacgcaataagcactccgcctggggagtacggccgcaaggctgaaactcaaaggaattgacggggacccgcacaagcggtggagcatgtggtttaattcgaagcaacgcgaagaaccttaccagggcttgacatcccgctgaccctcctagagataggagctctcttcggagcagcggtgacaggtggtgcatggttgtcgtcagctcgtgtcgtgagatgttgggttaagtcccgcaacgagcgcaacccttgtccttagttgccagcatttagttgggcactctagggagactgccgtcgacaagacggaggaaggtggggatgacgtcaaatcatcatgccccttatgtcctgggctacacacgtgctacaatggatggaacaacgggcagccaactcgcgagagtgcgcgaatcccttaaaaccattctcagttcggattgcaggctgcaactcgcctgcatgaagccggaatcgctagtaatcgcggatcagcatgccgcggtgaatacgttcccgggtcttgtacacaccgcccgtcacaccacgagagtttgcaacacccgaagtcggtgaggtaaccgcaaggagccagccgccgaaggtggggcagatgattggggtgaagtcgtaacaaggtatccg

SEQ ID NO: 170 - DNA, 1415 bp, Aneurinibacillus terranovensis
gacgaacgctggcggcgtgcctaatacatgcaagtcgagcggacytttaaaagcttgcttttaaaggttagcggcggacgggtgagtaacacgtgggcaacctgcctgtaagctcgggataactccgggaaaccggagctaataccgaatacgattcgcaaccgcatggttgcgaatggaaagttttcgaacacttacagatgggcccgcggcgcattagctggttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggttttcggatcgtaaagctctgttgtcagggaagaaccgccgggacgacctcccggtctgacggtacctgacgagaaagccccggctaactacgtgccagcagccgcggtaatacgtagggggcaagcgttgtccggaattattgggcgtaaagcgcgcgcaggcggccttttaagtcaggtgtgaaagcccgcggctcaaccgtggagggccacctgaaactgggaggcttgagtgcaggagaggagagcggaattccacgtgtagcggtgaaatgcgtagagatgtggaggaacacccgtggcgaaggcggctctctggcctgtaactgacgctgaggcgcgaaagcgtggggagcaaacaggattagataccctggtagtccacgccgtaaacgatgagtgctaggtgttggggactccaatcctcagtgccgcagctaacgcaataagcactccgcctggggagtacggccgcaaggctgaaactcaaaggaattgacggggacccgcacaagcggtggagcatgtggtttaattcgaagcaacgcgaagaaccttaccaggacttgacatcccgctgacccctctagagatagaggctcccttcggggcagcggtgacaggtggtgcatggttgtcgtcagctcgtgtcgtgagatgttgggttaagtcccgcaacgagcgcaacccttgtccgtagttgccagcattgagttgggcactctacggagactgccgtcgacaagacggaggaaggtggggatgacgtcaaatcatcatgccccttatgtcctgggctacacacgtgctacaatggatggtacaacgggccgccagctcgcgagagtgagcgaatccctaaaaaccattctcagttcggattgcaggctgcaactcgcctgcatgaagccggaatcgctagtaatcgcggatcagcatgccgcggtgaatacgttcccgggtcttgtacacaccgcccgtcacaccacgagagtttgcaacacccgaagtcggtgaggtaacc

SEQ ID NO: 171 - DNA, 1219 bp, Aneurinibacillus thermoaerophilus
ttcctgaggttagcggcggacgggtgagtaacacgtaggcaacctgcctgtacgaccgggataactccgggaaaccggagctaataccggataggatgccgaaccgcatggttcggcatggaaaggcctttgagccgcgtacagatgggcctgcggcgcattagctagttggtggggtaacggcctaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgaggaaggtcttcggatcgtaaaactctgttgtcagggaagaaccgccgggatgacctcccggtctgacggtacctgacgagaaagccccggctaactacgtgccagcagccgcggtaatacgtagggggcaagcgttgtccggaattattgggcgtaaagcgcgcgcaggcggcttcttaagtcaggtgtgaaagcccacggctcaaccgtggagggccatctgaaactggggagcttgagtgcagaaggagagcggaattccacgtgtacggtgaaatgcgtaagatgtggaggaacaccagtggcgaaggcggctctctggcctgtaactgacgtgaggcgcgaaagcgtggggagcaaacaggattaataccctggtagtcacccgtaaacgatgagtgctaggtgttggggagtccacctcctcagtgcgcataacgcaataacactcccctgggagtacgccgcaaggctgaaactcaaaggaattgacggggacccgcacaagcggtggagcatgtggtttaatttaagcaacgcgaaaaccttaccagggcttgacatcccgctgacccctccagagatggaggtttccttcgggacagcggtgacaggtggtgcatggttgtcgtcagctcgtgtcgtgagatgttgggttaagtcccgcaacgagcgcaacccttgtcctttgttgccagcattcagttgggcactctaaggagactgccgtcgacaagacggaggaaggtggggatgacgtcaaatcatcatgccccttatgtcctgggctacacacgtgctacaatggacggtacaacgggcgtgccaacccgcgagggtgagccaatccctaaaaaccgttctcagttcggattgcaggctgcaactcgc

SEQ ID NO: 172 - DNA, 1541 bp, Anoxybacillus contaminans
ttagaggttgatcctggctcaggacgaacgctggcggcgtgcctaatacatgcaagtcgagcggaccgaaaagaagcttgcttcgattcggttagcggcggacgggtgagtaacacgtgggcaacctgccctgtagacggggataacaccgagaaatcggtgctaataccggataacacgaaakgycgcatggyctttcgttgaaaggcggcgcaagctgtcgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggattgtaaagctctgttgttagggaagaacaagtaccgcagtaactggcggtaccttgacggtacctaacgagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagaggggttacaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccttgacaacccaagagattgggcgttccccttcgggggacaaggtgacaggtggtgcatggttgtcgtcagctcgtgtcgtgagatgttgggttaagtcccgcaacgagcgcaacccttgaccttagttgccagcattgagttgggcactctaaggtgactgccgatgacaaatcggaggaaggtggggatgacgtcaaatcatcatgccccttatgacctgggctacacacgtgctacaatgggcggtacaaagggttgcaaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgccgaaggtggggcagatgattggggtgaagtcgtaacaaggtagccgtatcggaaggtgcggctggatca

SEQ ID NO: 173 - DNA, 1405 bp, Anoxybacillus flavithermus
  modified_base (12)..(12): a, c, t, g, unknown or other
gcggacgaatcnaaagcttgcttttgattcgttagcggcggacgggtgagtaacacgtgggcaacctgccctgtagacggggataacaccgagaaatcggtgctaataccggataacacgaaatgtcgcatgacgtttcgttgaaagacggcgcaagctgtcgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaacgcagtaactggcgttaccgtgacggtacctaacgagaaagccacggctaactacgtgccagcagccgcggtaatacgtaggtggcaagcgttgtccggaattattgggcgtaaagcgcgcgcaggcggttccttaagtctgatgtgaaagccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgtaagtgttagagggtatccgccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaagtcttgacatcccctgacaacccgagagatcgggcgttcccccttcggggggacagggtgacaggtggtgcatggttgtcgtcagctcgtgtcgtgagatgttgggttaagtcccgcaacgagcgcaaccctcgaccttagttgccagcattcagttgggcactctaaggtgactgccggctaaaagtcggaggaaggtggggatgacgtcaaatcatcatgccccttatgacctgggctacacacgtgctacaatgggcggtacaaagggtcgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagc

SEQ ID NO: 174 - DNA, 1483 bp, Arcanobacterium haemolyticum
  modified_base (679)..(679): a, c, t, g, unknown or other
cgaacgctggcggcgtgcttaacacatgcaagtcgaacgatgaaggctcctgcttgcgggggttggattagtggcgaacgggtgagtaatacgtgagtaacctgcccctttctcttgggataagccttggaaacgaggtctaatactagatattctgcttctgccgcatggtgggggttggaaaggttttttctggtgggggatgggctcacggcctatcagcttgttggtggggtgatggcctaccaaggcgtcgacgggtagccggcctgagagggtgaccggccacattgggactgagatacggcccagactcctacgggaggcagcagtggggaatattgcacaatggacggaagtctgatgcagcgaacgccgcgtgggggatgaaggctttcgggttgtaaactccttttaacactgaacaaggcgaaagttgagggtaggtgttgaataagcgccggctaactacgtgccagcagccgcggtaatacgtagggcgcgagcgttgtccggaattattgggcgtaaagagctcgtaggcggtttgtcgcgtctgctgtgaaagaccggggcttaactccggggctgcagtgggtacgggcaggctagagtgcggtaggggtaattggaattcctggtgtagcggtggaatgcgcagatatcaggaggaacaccnatggcgaaggcaggttactgggccgttactgacgctgaggagcgaaagcatggggagcgaacaggattagataccctggtagtccatgccgtaaacgttgggcactaggtgtggggccttttccatgggttctgtaccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccgggattatgcagagatgtgtgagtcttcggactggtgtacaggtggtgcatggttgtcgtcagctcgtgtcgtgagatgttgggttaagtcccgcaacgagcgcaacccttgtcttgtgttgccagcacgttatggtggggactcacgagagactgccggggttaactcggaggaaggtggggatgacgtcaaatcatcatgccccttatgtcttgggcttcacgcatgctacaatggctggtacagagggttgcgagcttgtgagggtgagcgaatcccttaaagccagtctcagttcggattggggtctgcaactcgaccccatgaagtcggagtcgctagtaatcgcagatcagccaacgctgcggtgaatacgttcccgggccttgtacacaccgcccgtcacgtcacgaaagttggtaacacccgaagcccgtggcctaactcgtttgagggggagcggacgaaggtgggattagccattgggacgaagtcgtaacaaggtagccgtaccggaagg

SEQ ID NO: 175 - DNA, 1293 bp, Arcanobacterium pyogenes
  modified_base (921)..(921): a, c, t, g, unknown or other
catgcagtcgaacgatgaagccggggctttttgttttggtggattagtggcgaacgggtgagtaatacgtgagtaacctgcccttgtctttgggataagcctgggaaactgggtctaataccggatattctgcttttgccgcatggtgggggttggaaagattttttggatggggatgggctcacggcctatcagcttgttggtggggtgatggcctaccaaggcgtcgacgggtagccggcctgagagggtgaccggccacattgggactgagatacggcccagactcctacgggaggcagcagtggggaatattgcacaatggacgcaagtctgatgcagcgacgccgcgtgggggatgaaggctttcgggttgtaaactcctttcagtacagaagaagcatttttgtgacggtatgtgcagaagaagcgccggctaactacgtgccagcagccgcggtaatacgtagggcgcgagcgttgtccggaattattgggcgtaaagagctcgtaggcggtttgttgcgcctgctgtgaaagaccggggcttaacttcggggttgcagtgggtacgggcagactagagtgtggtaggggtaattggaattcctggtgtagcggtggaatgcgcagatatcaggaggaacaccgatggcgaaggcaggttactgggccattactgacgctgaggagcgaaagcgtgggtagcgaacaggattagataccctggtagtccacgctgtaaacgttgggcactaggtgtggggccttttccacgggttctgcgccgtagctaacgctttaagtgccccgcctggggagtacggccgcaaggttaaaactcaaggaattgacgggggcccgcacaagcggcggagcatgcggattaattcgatgcaacgcgaagaaccttaccaaggnttgacatacactgcgatgtgccagagatgtgcagccttcgggtggtgtacaggtggtgcatggttgtcgtcagctcgtgtcgtgagatgttgggttaagtcccgcaacgagcgcaacccttgtcctgtgttgccagcatgttgtggtggggactcacgggagactgccggggttaactcggaggaaggtggggatgacgtcaaatcatcatgccccttatgtcttgggcttcacgcatgctacaatggccggtacagagggttgcgagcctgtgagggtgagctaatcccttaaagctggtctcagttcggattggggtctgcaactcgaccccatgaagtcggagtcgctagtaatcgcagatcagcaacg

SEQ ID NO: 176 - DNA, 1519 bp, Arcobacter butzleri
tttatggagagtttgatcctggctcagagtgaacgctggcggcgtgcttaacacatgcaagtcgaacgagaacggattatagcttgctataattgtcagctaagtggcgcacgggtgagtaatgtataggtaatatgcctcttactaagggataacaattggaaacgattgctaataccttatattcctttttatcaaaagataaaaagggaaagatttattggtaagagattagcctgtattgtatcagttagttggtggggtaatggcctaccaagacgatgacgcataactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataagaagataatgacggtattatatgaataagcaccggctaactccgtgccagcagccgcggtaatacggagggtgcaagcgttactcggaatcactgggcgtaaagagcgtgtaggcggattgataagtttgaagtgaaatcctatagcttaactatagaactgctttgaaaactgttaatctagaatgtgggagaggtagatggaatttctggtgtaggggtaaaatccgtagagatcagaaggaataccgattgcgaaggcgatctactggaacaatattgacgctgagacgcgaaagcgtggggagcaaacaggattagataccctggtagtccacgccctaaacgatgtacactagttgttgtgaggctcgaccttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaatgatttagagatagattagtgtctgcttgcagaaacttgcatacaggtgctgcacggctgtcgtcagctcgtgtcgtgagatgttgggttaagtcccgcaacgagcgcaaccctcgtccttagttgctaacagttcggctgagaactctaaggagactgcctacgcaagtaggaggaaggtgaggatgacgtcaagtcatcatggcccttacgtccagggctacacacgtgctacaatggggtatacaaagagcagcaatacggtgacgtggagcaaatctcaaaaatgcctcccagttcggattgtagtctgcaactcgactacatgaagttggaatcgctagtaatcgtagatcagctatgctacggtgaatacgttcccgggtcttgtactcaccgcccgtcacaccatgggagttgaactcattcgaagcggggatgctaaagtagctaccttccacagtggattcagcgactggggtgaagtcgtaacaaggtaaccgtaggagaacctgcggttggatcacctcctttca

SEQ ID NO: 177 - DNA, 1462 bp, Arcobacter cryaerophilus
  modified_base (195)..(195): a, c, t, g, unknown or other
  modified_base (936)..(936): a, c, t, g, unknown or other
  modified_base (1098)..(1098): a, c, t, g, unknown or other
atggagagtttgatcctggctcagagtgaacgctggcggcgtgcttaacacatgcaagtcgaacgagaacggattatagcttgctataattgtcagctaagtggcgcacgggtgagtaatgtataggtaatatgcctcttactaagggataacaattggaaacgattgctaataccttatactccttgttaactnaagttaataagggaaagatttattggtaagagattagcctgtattgtatcagttagttggtggggtaatggcctaccaagacaatgacacataactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatatgagaagataatgacggtattatatgaataagcaccggctaactccgtgccagcagccgcggtaatacggggggtgcaagcgttactcggaatcactgggcgtaaagagcatgtaggcggattgataagtttgaagtgaaatcctatagcttaactatagaactgctttgaaaactgttaatctagaatgtgggagaggtagatggaatttctggtgtaggggtaaaatccgtagagatcagaaggaataccgattgcgaaggcgatctactggaacattattgacgctgagatgcgaaagcgtggggagcaaacaggattagataccctggtagtccacgccctaaacgatgtacactagttgttgtgagacttgatcttgcagtaatgcagttaacacattaagtgtaccgcctggggagtacggtcgcaagattaaaactcaaaggaatagacggggacccgcacaagcggtggagcatgtggtttaatncgaagatacacgaagaaccttacctggacttgacatagtaagaactttctagagatagattggtgtctgcttgcagaaacttatatacaggtgctgcacggctgtcgtcagctcgtgtcgtgagatgttgggttaagtcccgcaacgagcgcaaccctcgtntttagttgctaacagttcggctgagaactctaaacagactgcctacgcaagtaggaggaaggtgaggacgacgtcaagtcatcatggcccttacgtccagggctacacacgtgctacaatgggatatacaaagagccgcaatacggtgacgtggagcaaatcttataaaatatctcccagttcggattgtagtctgcaactcgactacatgaagttggaatcgctagtaatcgtagatcagctatgctacggtgaatacgttcccgggtcttgtactcaccgcccgtcacaccatgggagtcgaactcattcgaagcggggatgctaaaatagctaccttccacagtggatttggcgactgggg

SEQ ID NO: 178 - DNA, 1482 bp, Arthrobacter agilis
gatcctggctcaggatgaacgctggcggcgtgcttaacacatgcaagtcgaacgatgaacctcacttgtggggggattagtggcgaacgggtgagtaacacgtgagtaacctgcccttgactctgggataagcctgggaaaccgggtctaatactggatacgaccttctggcgcatgccatgttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgaaggccttcgggttgtaaacctctttcagtagggaagaagcctgtcttttgggtgggtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggcttaactccggatctgcggtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaatgatgcagagatgtgtcagccacttgtggccggtttacaggtggtgcatggttgtcgtcagctcgtgtcgtgagatgttgggttaagtcccgcaacgagcgcaaccctcgttccatgttgccagcgggttatgccggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattgaggtctgcaactcgacctcatgaagttggagtcgctagtaatcgcagatcagcaacgctgcggtgaatacgttcccgggccttgtacacaccgcccgtcaagtcacgaaagttggtaacacccgaagccggtggcctaaccccttgtgggagggagccgtcgaaggtgggaccggcgattgggactaagtcgtaacaag

SEQ ID NO: 179 - DNA, 1519 bp, Arthrobacter arilaitensis
ggagagtttgatcctggctcaggatgaacgctggcggcgtgcttaacacatgcaagtcgaacgatgaagcccagcttgctgggtggattagtggcgaacgggtgagtaacacgtgagtaacctgcccccgactctgggataagcccgggaaactgggtctaataccggatattacctcttgccgcatggcaggtggtggaaagatttatcggtgggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggatttattgggcgtaaagagctcgtaggcggtttgtcgcgtctgccgtgaaagtccgaggctcaacctcggatctgcggtgggtacgggcagactagagtgatgtaggggagactggaattcctggtgtagcggtgaaatgcgcagatatcaggaggaacaccgatggcgaaggcaggtctctgggcatttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccagaccgcttcagagatggagtttcccttcggggctggttcacaggtggtgcatggttgtcgtcagctcgtgtcgtgagatgttgggttaagtcccgcaacgagcgcaaccctcgttccatgttgccagcacgtagtggtggggactcatgggagactgccggggtcaactcggaggaaggtggggatgacgtcaaatcatcatgccccttatgtcttgggcttcacgcatgctacaatggccggtacaatgggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccaccttgtgtggggggagtcgtcgaaggtgggactggcgattgggactaagtcgtaacaaggtagccgtaccggaaggtgcggctggatcacctcct

SEQ ID NO: 180 - DNA, 1468 bp, Arthrobacter bergerei
ctggctcaggacgaacgctggcggcgtgcttaacacatgcaagtcgaacgatgaccccgtgcttgcacgggtgattagtggcgaacgggtgagtaacacgtgagtaacctgcccctgactctgggataagcccgggaaactgggtctaatactggatatgacctttaaccgcatggtttttggtggaaagatttatcggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggatttattgggcgtaaagagctcgtaggcggtttgtcgcgtctgccgtgaaagtccgaggctcaacctcggatctgcggtgggtacgggcagactagagtgatgtaggggagactggaattcctggtgtagcggtgaaatgcgcagatatcaggaggaacaccgatggcgaaggcaggtctctgggcatctactgacgctgaggagcgaaagcatggggagcgaacaggattagataccctggtagtccatgccgtaaacgttgggcactaggtgtggggaacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttccagaccgcctcagagatggggtttcccttcggggctggttcacaggtggtgcatggttgtcgtcagctcgtgtcgtgagatgttgggttaagtcccgcaacgagcgcaaccctcgttccatgttgccagcacgtaaaggtggggactcatgggagactgccggggtcaactcggaggaaggtggggatgacgtcaaatcatcatgccccttatgtcttgggcttcacgcatgctacaatggccggtacaatgggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccaccttgtgtggagggagtcgtcgaaggtgggactggcgattgggactaagtcgtaaca

SEQ ID NO: 181 - DNA, 1464 bp, Arthrobacter globiformis
cctggctcaggatgaacgctggcggcgtgcttaacacatgcaagtcgaacgatgatccggtgcttgcaccggggattagtggcgaacgggtgagtaacacgtgagtaacctgcccttgactctgggataagcctgggaaactgggtctaataccggatatgactcctcatcgcatggtggggggtggaaagcttttgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggaccgccgcagaaatgtggtttctccttttggggccggttcacaggtggtgcatggttgtcgtcagctcgtgtcgtgagatgttgggttaagtcccgcaacgagcgcaaccctcgttccatgttgccagcgcgtaatggcggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagccgtcgaaggtgggactggcgattgggactaagtcg

SEQ ID NO: 182 - DNA, 1472 bp, Arthrobacter nicotianae
  modified_base (608)..(608): a, c, t, g, unknown or other
gatcctggctcaggatgaacgctggcggcgtgcttaacacatgcaagtcgaacgatgaagcccagcttgctgggtggattagtggcgaacgggtgagtaacacgtgagtaacctgcccccgactctgggataagcccgggaaactgggtctaataccggatatgacctcgcaccgcatggtgcggggtggaaagatttatcggtgggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggatttattgggcgtaaagagctcgtaggcggtttgtcgcgtctgccgtgaaagtccgaggctcaacctcggatctgcggtgggtacggncagactagagtgatgtaggggagactggaattcctggtgtagcggtgaaatgcgcagatatcaggaggaacaccgatggcgaaggcaggtctctgggcatttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccagaccgctccagagatggggtttcccttcggggctggttcacaggtggtgcatggttgtcgtcagctcgtgtcgtgagatgttgggttaagtcccgcaacgagcgcaaccctcgttccatgttgccagcacgtagtggtggggactcatgggagactgccggggtcaactcggaggaaggtggggatgacgtcaaatcatcatgccccttatgtcttgggcttcacgcatgctacaatggccggtacaatgggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccacttgtgtgggggagtcgtcgaaggtgggactggcgattgggactaagtcgtaacaag

SEQ ID NO: 183 - DNA, 1345 bp, Atopobium minutum
tcaggatgaacgctggcggcgcgcctaacacatgcaagtcgaacgattaaagcatcttttagatgtgtataaagtggcgaacggctgagtaacacgtgggcaacctgcccttttctttgggatagctacgggaaaccgtgggtaataccgaatatttcttgagtgtcgcatggcacacaagacaaagcgtctagcggaaaaggatgggcccgcggcctgttagcttgttggtggggtaatggcctaccaaggcagttatgggtagccgggttgagagaccgaccggccagattgggactgagacacggcccagactcctacgggaggcagcagtggggaatcttgcgcaatgggggaaaccctgacgcagcgacgccgcgtgcgggatgaaggccttcgggttgtaaaccgctttcagcagggacgaggccgcaaggtgacggtacctgcagaagaagctccggctaaatacgtgccagcagccgcggtaatacgtatggagcaagcgttatccggattcattgggcgtaaagcgctcgtaggcggtctgttaggtcggtaagttaaatccgggggctcaacccccgtccgcttccgataccggcagacttgagtttggtaggggaaggtggaattcctagtgtagcggtggaatgcgcagatattaggaagaacaccggtggcgaaggcggccttctgggccataactgacgctgaggagcgaaagctaggggagcgaacaggattagataccctggtagtcctagccgtaaacgatggacactaggtgtggggggatgtaccttccgtgccgcagctaacgcattaagtgtcccgcctggggagtacgaccgcaaggttaaaactcaaaggaattgacgggrgcccgcacaagcagcggagcatgtggcttaattcgaagcaacgcgaagaaccttaccagggcttgacatttaggtgaagcggcggaaacgtcgtggccgaaaggagcctaaacaggtggtgcatggctgtcgtcagctcgtgtcgtgagatgttgggttaagtcccgcaacgagcgcaacccttgtcgcatgttgccagcaggtcaagctgggcacccgtgcgagaccgccggcgtcaagccggaggaaggtggggacgacgtcaagtcatcatgccccttatgtcctgggctgcacacgtgctacaatggtcggcacagcgggaagcaaacttgcgaaagtaagccaatcccttaaagccggccccagttcggattggaggctgcaacccgcctccatgaagtcggagttgctagtaatcgcggatcagcacgccgcggtgaatgcgttcccgggccttg

SEQ ID NO: 184 - DNA, 1517 bp, Atopobium parvulum
atggagagttcgatcctggctcaggatgaacgctggcggcgcgcctaacacatgcaagtcgaacgattaaagcaccttcgggtgtgtataaagtggcgaacggctgagtaacacgtgggcaacctgcccctttcattgggatagccacgggaaaccgtggataataccgaatacttcgagacttccgcatggaagactcgagaaagctccggcggagagggatgggcccgcggcctgttagcttgttggtggggtaacggcctaccaaggcaatgatgggtagctgggttgagagaccgaccagccagattgggactgagacacggcccagactcctacgggaggcagcagtggggaatcttgcacaatgggcgaaagcctgatgcagcgacgccgcgtgcgggatgaaggccttcgggttgtaaaccgctttcagcagggacgaggcgaaagtgacggtacctgcagaagaagccccggctaactacgtgccagcagccgcggtaatacgtagggggcaagcgttatccggattcattgggcgtaaagcgctcgtaggcggtctgttaggtcgggagttaaatccgggggctcaacccccgctcgctctcgataccggcagacttgagtttggtaggggaaggtggaattcctagtgtagcggtggaatgcgcagatattaggaagaacaccagtggcgaaggcggccttctgggccataactgacgctgaggagcgaaagctaggggagcaaacaggattagataccctggtagtcctagccgtaaacgatggacactaggtgtgggggagtatttcttccgtgccgcagctaacgcattaagtgtcccgcctggggagtacggccgcaaggctaaaactcaaaggaattgacgggggcccgcacaagcagcggagcatgtggtttaattcgaagcaacgcgaagaaccttaccagggcttgacatttaggtgaagcggcggaaacgtcgtggccgaaaggagcctaaacaggtggtgcatggctgtcgtcagctcgtgtcgtgagatgttaggttaagtcctgcaacgagcgcaaccctcgtcgtatgttgccagcggttaggccgggcacccatacgagaccgccggcgtcaagccggaggaaggtggggacgacgtcaagtcatcatgccccttatgtcctgggctacacacgtgctacaatggccggcacaatgggctgccaacccgcgagggtgagcgaatccctaaagccggtcccagttcggattggaggctgcaacccgcctccatgaagtcggagttgctagtaatcgcggatcagcacgccgcggtgaatgcgttcccgggccttgtacacaccgcccgtcacaccacccgagtcgattgcacccgaagtcgtcggcctaaccttttaggagggagacgccgaaggtgtggttggtaaggggggtgaagtcgtaacaaggtagccgtaccggaaggtgcggctggatcacctcctttctagggag

SEQ ID NO: 185 - DNA, 1518 bp, Atopobium rimae
atggagagttcgatcctggctcaggatgaacgctggcggcgcgcctaacacatgcaagtcgaacggttaaagcaccttttaggtgtgtataaagtggcgaacggctgagtaacacgtgggcaacctgccctcctcttggggatagcctcgggaaaccgaggataatacccgatacttcaatgtggccgcatgacgacattgagaaagcttttgcggagaaggatgggcccgcggcctgttagcttgttggtggggtagaggcctaccaaggcaatgatgggtagctgggttgagagaccgaccagccagattgggactgagacacggcccagactcctacgggaggcagcagtggggaatcttgcacaatgggcgaaagcctgatgcagcgacgccgcgtgcgggacgaaggccttcgggttgtaaaccgctttcagcagggacgaggcgaaagtgacggtacctgcagaagaagccccggctaactacgtgccagcagccgcggtaatacgtagggggcaagcgttatccggattcattgggcgtaaagcgctcgtaggcggtctgttaggtcgggagttaaatccggaggctcaacctccgcccgctcccgataccggcagacttgagtttggtaggggaaggtggaattcctagtgtagcggtggaatgcgcagatattaggaagaacaccagtggcgaaggcggccttctgggccataactgacgctgaggagcgaaagctaggggagcaaacaggattagataccctggtagtcctagctgtaaacgatggacactaggtgtgggagaatacgtcttccgtgccgcagctaacgcattaagtgtcccgcctggggagtacggccgcaaggctaaaactcaaaggaattgacggggacccgcacaagcagcggagcatgtggtttaattcgaagcaacgcgaagaaccttaccagggcttgacatgtaggtgaagcggcggaaacgtcgtggccgaaaggagcctacacaggtggtgcatggctgtcgtcagctcgtgtcgtgagatgttaggttaagtcctgcaacgagcgcaaccctcgtcgtatattgccagcggttcggccgggcacctatacgagaccgccggcgtcaagccggaggaaggtggggacgacgtcaagtcatcatgccccttatgtcctgggctacacacgtgctacaatggccggcacaatgagctgccaacccgcaagggcgagcgaatctctaaagccggtcccagttcggattggaggctgcaacccgcctccatgaagtcggagttgctagtaatcgcggatcagcacgccgcggtgaatgcgttcccgggtcttgtacacaccgcccgtcacaccacccgagtcgattgcacccgaagtcgtcggcctaaccttttaggagggagacgccgaaggtgtggttggtaaggggggtgaagtcgtaacaaggtagccgtaccggaaggtgcggctggatcacctcctttctagggag

SEQ ID NO: 186 - DNA, 1355 bp, Atopobium sp.
  BS2
aaagcaccttcgggtgtgtataaagtggcgaacggctgagtaacacgtgggcaacctgcccctctcattgggatagccacgggaaaccgtggataataccgaatacttcgagacttccgcatggaagactcgagaaagctccggcggagagggatgggcccgcggcctgttagcttgttggtggggtaacggcctaccaaggcaatgatgggtagctgggttgagagaccgaccagccagattgggactgagacacggcccagactcctacgggaggcagcagtggggaatcttgcacaatgggcgaaagcctgatgcagcgacgccgcgtgcgggatgaaggccttcgggttgtaaaccgctttcagcagggacgaggcgaaagtgacggtacctgcagaagaagccccggctaactacgtgccagcagccgcggtaatacgtagggggcaagcgttatccggattcattgggcgtaaagcgctcgtaggcggtctgttaggtcgggagttaaatccgggggctcaacccccgttcgctcccgataccggcagacttgagtttggtaggggaaggtggaattcctagtgtagcggtggaatgcgcagatattaggaagaacaccagtggcgaaggcggccttctgggccataactgacgctgaggagcgaaagctaggggagcaaacaggattagataccctggtagtcctagccgtaaacgatggacactaggtgtgggggaatatttcttccgtgccgcagctaacgcattaagtgtcccgcctggggagtacggccgcaaggctaaaactcaaaggaattgacgggggcccgcacaagcagcggagcatgtggtttaattcgaagcaacgcgaagaaccttaccagggcttgacatttaggtgaagcggcggaaacgtcgtggccgaaaggagcctaaacaggtggtgcatggctgtcgtcagctcgtgtcgtgagatgttaggttaagtcctgcaacgagcgcaaccctcgtcgtatgttgccagcggttaggccgggcacccatacgagaccgccggcgtcaagccggaggaaggtggggacgacgtcaagtcatcatgccccttatgtcctgggctacacacgtgctacaatggccggcacaatgggctgccaacccgcgagggtgagcgaatccctaaagccggtcccagttcggattggaggctgcaacccgcctccatgaagtcggagttgctagtaatcgcggatcagcacgccgcggtgaatgcgttcccgggccttgtacacaccgcccgtcacaccacccgagtcgattgcacccgaagtcgtcggcctaaccttttagga

SEQ ID NO: 187 - DNA, 1487 bp, Atopobium sp.
  F0209
gagtttgatcctggctcaggatgaacgctggcggcacgcttaacacatgcaagtcgaacgattaaagcaccttcgggtgtgtatagagtggcgaacggctgagtaacacgtgggcaacctgcccttcagtttggaatagctacgggaaaccgtgggtaataccggatgatccacttccctcgcatgaaggaagtggcaaagatttatcgctgaaggatgggcccgcggcctgttagcttgttggtgaggtaacggctcaccaaggcagtaatgggtagccgggttgagagaccgaccggccagattgggactgagacacggcccagactcctacgggaggcagcagtggggaatcttgcgcaatgggcgaaagcctgacgcagcgatgccgcgtgcgggatgaaggccttcgggtcgtaaaccgctttcagcagggacgaggccgcaaggtgacggtacctgcagaagaagccccggctaactacgtgccagcagccgcggtaatacgtagggggcgagcgttatccggattcattgggcgtaaagcgcgcgtaggcggcctgttaggtcaggagttaaatccgggggctcaacccccgtccgctcctgataccggcaggcttgagtctggtaggggaaggcggaattccaagtgtagcggtggaatgcgcagatatttggaagaacaccggtggcgaaggcggccttctgggccacgactgacgctgaggcgcgaaagctaggggagcgaacaggattagataccctggtagtcctagccgtaaacgatggacactaggtgtggggggatcatccctccgtgccgcagctaacgcattaagtgtcccgcctggggagtacggccgcaaggctaaaactcaaaggaattgacgggggcccgcacaagcagcggagcatgtggcttaattcgaagcaacgcgaagaaccttaccagggcttgacatataggtgaagcggtggaaacaccgtagccgaaaggagcctatacaggtggtgcatggctgtcgtcagctcgtgtcgtgagatgttgggttaagtcccgcaacgagcgcaacccccgtcgtatgttgccagcggttcggccgggcacccatacgagaccgccggcgtcaagccggaggaaggtggggacgacgtcaagtcatcatgccccttatgtcctgggctgcacacgtgctacaatggccggcacaatgggctgccaggtcgcgagaccgagcgaatccctaaagccggccccagttcggattggaggctgcaacccgcctccatgaagtcggagttgctagtaatcgcggatcagcacgccgcggtgaatgcgttcccgggccttgtacacaccgcccgtcacaccacccgagtcgtctgcacccgaagtcgccggcccaaccttttggagggaggtgccgaaggtgtggagggtaaggggggtgaagtcgtaacaaggtagccgtaccggaaggtgc

SEQ ID NO: 188 - DNA, 1473 bp, Atopobium sp.
  ICM42b10
agagtttgatcctggctcaggatgaacgctggcggcgcgcctaacacatgcaagtcgaacgattaaagcaccttcgggtgtgtataaagtggcgaacggctgagtaacacgtgggcaacctgcccctctcattgggatagccacgggaaaccgtggataataccgaatacttcgagtctcccgcatggaagactcgagaaagctccggcggagagggatgggcccgcggcctgttagcttgttggtggggtaacggcctaccaaggcaatgatgggtagctgggttgagagaccgaccagccagattgggactgagacacggcccagactcctacgggaggcagcagtggggaatcttgcacaatgggcgaaagcctgatgcagcgacgccgcgtgcgggatgaaggccttcgggttgtaaaccgctttcagcagggacgaggcgaaagtgacggtacctgcagaagaagccccggctaactacgtgccagcagccgcggtaatacgtagggggcaagcgttatccggattcattgggcgtaaagcgctcgtaggcggtctgttaggtcgggagttaaatccgggggctcaacccccgttcgctcccgataccggcagacttgagtttggtaggggaaggtggaattcctagtgtagcggtggagtgcgcagatattaggaagaacaccagtggcgaaggcggccttctgggccataactgacgctgaggagcgaaagctaggggagcaaacaggattagataccctggtagtcctagccgtaaacgatggacactaggtgtgggggaatatttcttccgtgccgcagctaacgcattaagtgtcccgcctggggagtacggccgcaaggctaaaactcaaaggaattgacgggggcccgcacaagcagcggagcatgtggtttaattcgaagcaacgcgaagaaccttaccagggcttgacatttaggtgaagcggcggaaacgtcgtggccgaaaggagcctaaacaggtggtgcatggctgtcgtcagctcgtgtcgtgagatgttaggttaagtcctgcaacgagcgcaaccctcgtcgtatgttgccagcggttaggccgggcacccatacgagaccgccggcgtcaagccggaggaaggtggggacgacgtcaagtcatcatgccccttatgtcctgggctacacacgtgctacaatggccggcacaatgggctgccaacccgcgagggtgagcgaatccctaaagccggtcccagttcggattggaggctgcaacccgcctccatgaagtcggagttgctagtaatcgcggatcagcacgccgcggtgaatgcgttcccgggccttgtacacaccgcccgtcacaccacccgagtcgattgcacccgaagtcgtcggcctaaccttttaggagggagacgccgaaggtgtggttggtaaggggggtgaagtcgtaacaaggtaacc

SEQ ID NO: 189 - DNA, 1267 bp, Atopobium sp.
  ICM57
cgctggcggcgcgcctaacacatgcaagtcgaacgagtggcgaacggctgagtaacacgtgggcaacctgcccctctcattgggatagccacgggaaaccgtggataataccgaatactgaaaggcggagagggatgggcccgcggcctgttagcttgttggtggggtaacggcctaccaaggcaatgatgggtagctgggttgagagaccgaccagccagattgggactgagacacggcccagactcctacgggaggcagcagtggggaatcttgcacaatgggcgaaagcctgatgcagcgacgccgcgtgcgggatgaaggccttcgggttgtaaaccgctttcagcagggacgatgacggtacctgcagaagaagccccggctaactacgtgccagcagccgcggtaatacgtagggggcaagcgttatccggattcattgggcgtaaagcgctcgtaggcggtctgttaggtcgggagttaaatccgggggctcaacccccgttcgctcccgataccggcagacttgagtttggtaggggaaggtggaattcctagtgtagcggtggaatgcgcagatattaggaagaacaccagtggcgaaggcggccttctgggccaactgacgctgaggagcgaaagctaggggagcaaacaggattagataccctggtagtcctagccgtaaacgatggacactaggtgtgggggcttccgtgccgcagctaacgcattaagtgtcccgcctggggagtacggccgcaaggctaaaactcaaaggaattgacgggggcccgcacaagcagcggagcatgtggtttaattcgaagcaacgcgaagaaccttaccagggcttgacattaacaggtggtgcatggctgtcgtcagctcgtgtcgtgagatgttaggttaagtcctgcaacgagcgcaaccctcgtcgtatgttgccagcggccgggcacccatacgagaccgccggcgtcaagccggaggaaggtggggacgacgtcaagtcatcatgccccttatgtcctgggctacacacgtgctacaatggccggcaatgggctgccaacccgcgagggtgagcgaatccctccggtcccagttcggatggaggctgcaacccgcctccagaagtcggagttgctagtaatcgcggatcagcacgccgcggtgaatgcgttcccgggccttgtacacaccgcccgtcacaccacccgagtcgattgcacccgaagtcgtcgcctagggagacgccgaa

SEQ ID NO: 190 - DNA, 1521 bp, Atopobium vaginae
tttgaacggagagttcgatcctggctcaggatgaacgctggcggcgcgcctaacacatgcaagtcgaacgattaaagcaccttcgggtgtgtataaagtggcgaacggctgagtaacacgtgggcaacctgccctttgcactgggatagcctcgggaaaccgaggttaataccggatactccatatatatcgcatgatgtatatgggaaagctccgacggcaaaggatgggcccgcggcctgttagctagttggtggggtaacggcctaccaaggcaatgatgggtagccgggttgagagaccgaccggccagattgggactgagacacggcccagactcctacgggaggcagcagtggggaatcttgcacaatgggcgaaagcctgatgcagcgacgccgcgtgcgggatgaaggccttcgggttgtaaaccgctttcagcagggacgaggccgcaaggtgacggtacctgcagaagaagccccggctaactacgtgccagcagccgcggtaatacgtagggggcaagcgttatccggattcattgggcgtaaagcgcgcgtaggcggtttgttaggtcaggagttaaatctgggggctcaacccctatccgctcctgataccggcaggcttgagtctggtaggggaaggcggaattccaagtgtagcggtgaaatgcgcagatatttggaagaacaccggtggcgaaggcggccttctgggccacgactgacgctgaggcgcgaaagctaggggagcgaacaggattagataccctggtagtcctagccgtaaacgatggacactaggtgtggggagattatactttccgtgccgcagccaacgcattaagtgtcccgcctggggagtacggtcgcaagactaaaactcaaaggaattgacgggggcccgcacaagcagcggagcatgtggcttaattcgaagcaacgcgaagaaccttaccagggcttgacatttaggtgaagcagtggaaacactgtggccgaaaggagcctaaacaggtggtgcatggctgtcgtcagctcgtgtcgtgagatgttgggttaagtcccgcaacgagcgcaacccttgtcgcatgttgccagcggttaaagccgggcacccatgcgagaccgccggcgttaagccggaggaaggtggggacgacgtcaagtcatcatgccccttatgtcctgggctgcacacgtgctacaatggccggcacagagggctgcaactgcgcgagcagaagcgaatccctaaagccggtcccagttcggattggaggctgcaacccgcctccatgaagtcggagttgctagtaatcgcggatcagcacgccgcggtgaatgcgttcccgggccttgtacacaccgcccgtcacaccacccgagtcgtctgcacccgaagtcgtcggcctaacctgcaaaggagggagacgccgaaggtgtggagggtaaggggggtgaagtcgtaacaaggtagccgtaccggaaggtgcggctggatcacctcctttct

SEQ ID NO: 191 - DNA, 1285 bp, Aurantimonas coralicida
gtaacgcgtgggaatctacccatccctacgggatagctccgggaaactggagataataccgtatacgtcctccgggagaaagatttatcggggatggatgagcccgcgttggattagctagttggtggggtaatggcctaccaaggcgacgatccatagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcagtggggacgataatgacggtacccacagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctctgatactgggtgtcttgagtgtggtagaggtgagtggaattgcgagtgtagaggtgaaattcgtagatattcgcaggaacaccagtggcgaaggcggctcactggaccacaactgacgctgaggtgcgaaagcgtggggagcaaacaggattagataccctggtagtccacgccgtaaacgatggaagctagccgtcggaggatttatccttcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagctcttgacatgcctcgacggtatccggagacggatgccttccttcgggacgagtgcacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggcggtgacagtgggcagccaactcgcgagagtgagctaatcccaaaaaaccgtctcagttcggattgcactctgcaactcgggtgcatgaagttggaatcgctagtaatcgtggatcagcatgccacggtgaatacgttcccgggccttgtacacaccgcccgtcacaccatggkagwkgkttmtmmcsgaasatrgtsc

SEQ ID NO: 192 - DNA, 1390 bp, Aureimonas altamirensis
ctcagaacgaacgctggcggcaggcttaacacatgcaagtcgaacgcacctttcggggtgagtggcagacgggtgagtaacgcgtgggaatctacccttctctacgggatagctccgggaaactggaattaataccgtatacgtcctgagggagaaagatttatcggggaaggatgagcccgcgttggattagctagttggtggggtaaaggcctaccaaggcgacgatccatagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcagtggggacgataatgacggtacccacagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatcttgagttcggaagaggtaagtggaattgcgagtgtagaggtgaaattcgtagatattcgcaggaacaccagtggcgaaggcggcttactggtccgatactgacgctgaggtgcgaaagcgtggggagcaaacaggattagataccctggtagtccacgccgtaaacgatggaagctagccgtcgggtgatttatcactcggtggcgcagcaaacgcattaagcttcccgcctggggagtacggtcgcaagattaaaactcaaaggaattgacgggggcccgcacaagcggtggagcatgtggtttaattcgaagcaacgcgcagaaccttaccagctcttgacatgccacgacgatgaccggagacggacatcttccttcgggacgtggacacaggtgctgcatggctgtcgtcagctcgtgtcgtgagatgttgggttaagtcccgcaacgagcgcaaccctcgcccttagttgccagcattgagttgggcactctaaggggactgccggtgataagccgagaggaaggtggggatgacgtcaagtcctcatggcccttacgggctgggctacacacgtgctacaatggcggtgacaatgggcagccaactcgcgagagtgcgctaatcccaaaaagccgtctcagttcggattgcactctgcaactcgggtgcatgaagttggaatcgctagtaatcgtggatcagcatgccacggtgaatacgttcccgggccttgtacacaccgcccgtcacaccatgggagttggttctacccgaaggtggtgcgctaaccgcaaggaggcagccaaccacgg

SEQ ID NO: 193 - DNA, 1319 bp, Auritibacter ignavus
ctggcggcgtgcttaacacatgcaagtcgaacgagtggcgaacgggtgagtatcacgtgagtaacctgcccttgactctgggataagcctgggaaactgggtctaatactggatatggaaaggcggttttggatggactcgcggcctatcagcttgttggtggggtaatggcctaccaaggcttcgacgggtagccggcctgagagggtgaccggccacactgggactgagacacggcccagactcctacgggaggcagcagtgggggatattgcacaatgggcgcaagcctgatgcagcgacgtcgcgtgagggatgacggccttcgggttgtaaacctctttcagcagggaagatgacggtacctgcagaagaagcaccggctaactacgtgccagcagccgcggtaatacgtagggtgcgagcgttatccggaattattgggcgtaaagagctcgtaggcggtttgtcgcgtctgctgtgaaagctcagggcttaactctgagtttgcagtgggtacgggcagactggagtgcagtaggggagattggaattcctggtgtagcggtggaatgcgcagatatcaggaggaacaccgatggcgaaggcaggtctctgggctgactgacgctgaggagcgaaagcatggggagcgaacaggattagataccctggtagtccatgccgtaaacggtgggcgctaggtgtgagtcggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggtggtgcatggttgtcgtcagctcgtgtcgtgagatgttgggttaagtcccgcaacgagcgcaacccttgtcttatgttgccagcacgtggggactcataggagactgccggggtcaactcggaggaaggtggggatgacgtcaaatcatcatgccccttatgtcttgggcttcacgcatgctacaatggccggcagagggttgcgatactgtgaggttgagctaatcccttctggtctcagttcggatggggtctgcaactcgaccccagaagtcggagtcgctagtaatcgcagatcagcaatgctgcggtgaatacgttcccgggccttgtacacaccgcccgtcgagtcacgaaagttggtaacacccgaagccggtgcctagggagccgtcgaaggtgggactggcgattgggactaagtcgtaacaaggtagccgtaccggaag

SEQ ID NO: 194 - DNA, 1429 bp, Averyella dalhousiensis
ccaggagctacatgcagtcgagcggtagcacaggggagcttgctcctgggtgacgagcggcggacgggtgagtaatgtctgggaaactgcctgatggagggggataactactggaaacggtagctaataccgcataacgtctacggaccaaagtgggggaccttcgggcctcatgccatcagatgtgcccagatgggattagctagtaggtggggtaatggctcacctaggcgacgatccctagctggtctgagaggatgaccagccacactggaactgagacacggtcgagactcctacgggaggcagcagtggggaatattgcacaatgggcgcaagcctgatgcagccatgccgcgtgtgtgaagaaggccttcgggttgtaaagcactttcagcgaggaggaagggttcagtgttaatagcactgttcattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccctgtataa

SEQ ID NO: 195 - DNA, 1403 bp, Bacillus aeolius
tggcggcgtgcctaatacatgcaagtcgagcgaacggatggagagcttgctctcctgacgttagcggcggacgggtgagtaacacgtgggcaacctgcctgtaagaccgggataacttcgggaaaccggagctaataccggataattcctttcctcgcatgaggaaaggttgaaaggcggcttcggctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggtcttcggatcgtaaagctctgttgttagggaagaacaagtaccgttcgaataggcggtaccttgacggtacctaaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggagacttgagtgcagaagaggagagcggaattccatgtgtagcggtgaaatgcgtagagatatggaggaacaccagtggcgaaggcggctctcttgtctgtaactgacgctgaggcgcgaaagcgttgggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgctacctctagatagagggttccccttcgggggacggaatgacaggtggtgcatggttgtcgtcagctcgtgtcgtgagatgttgggttaagtcccgcaacgaacgcaacccttgaccttagttgccagcattcagttgggcactctaaggtgactgccggtgacaaaccggaagaaagtggggatgacgtcaaatcatcatgccccttatgacctgggctacacacgtgctacaatgggtggtacaaagggctgcgatgccgcgaggctgagccaatcccaaaaaaccactctcagttcggattgcaggctgcaactcgcctgcatgaagccggaatcgctagtaatcgcggatcagcatgccgcggtgaatacgttcccgggccttgtacacaccgcccgtcacaccacgagagtttgcaacaccc

SEQ ID NO: 196 - DNA, 1382 bp, Bacillus aerophilus
  modified_base (8)..(12): a, c, t, g, unknown or other
agcggacnnnnnggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgagagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgataaccctagagatagggctttcccttcggggaccggggagggtgatgggaaactgggaaacttgctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtg

SEQ ID NO: 197 - DNA, 1392 bp, Bacillus aestuarii
gcggaccaatagaagcttgcttctgttggttagcggcggacgggtgagtaacacgtgggcaacctgcctgtaagactgggataacttcgggaaaccggagctaataccggataattcatcccctcgcatgagggggtgctgaaagtcggttcacgctgacacttacagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagttgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttacgacctccctagagatagggatttccccttcgggggacggaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgttacaatggatggtacaaagggcagcgaaaccgcgaggtcgagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaac

SEQ ID NO: 198 - DNA, 1505 bp, Bacillus alcalophilus
  modified_base (97)..(97): a, c, t, g, unknown or other
  modified_base (203)..(203): a, c, t, g, unknown or other
  modified_base (441)..(441): a, c, t, g, unknown or other
gacgaacgctggcggcgtgcctaatacatgcaagtcgagcggaccaaagggagcttgctcccagaggttagcggcggacgggtgagtaacacgtggncaacctgccctgtagactgggataacatcgagaaatcggtgctaataccggataatcaaaggaatcacatggttcttttgtaaaagatggctccggctatcactangggatgggcccgcggcgcattagctagttggtaaggtaatggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgntcgaataggtcggcaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaatatcggggctcaaccccgaggggtcattggaaactgggagacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctttgaccactctagagatagagctttccccttcgggggacaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcgaaaccgcgaggtcgagccaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtg

SEQ ID NO: 199 - DNA, 1410 bp, Bacillus amyloliquefaciens
  modified_base (965)..(965): a, c, t, g, unknown or other
  modified_base (1393)..(1393): a, c, t, g, unknown or other
  modified_base (1397)..(1398): a, c, t, g, unknown or other
tcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaacttaccgcggttatacgtcggtggcaagcgttagacagnaatcgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtancctnnaggagccagccg

SEQ ID NO: 200 - DNA, 1391 bp, Bacillus anthracis
  modified_base (9)..(11): a, c, t, g, unknown or other
  modified_base (1380)..(1380): a, c, t, g, unknown or other
cttgctctnnngaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgtatccggaattattgggcgtaaagcgcgcgcaggtggtttcttaagtctgatgtgaaagccccggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttanggagccagccg

SEQ ID NO: 201 - DNA, 1411 bp, Bacillus atrophaeus
tcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccg

SEQ ID NO: 202 - DNA, 1442 bp, Bacillus badius
acgaacgctggcggcgtgcctaatacatgcaagtcgagcggacttgacggaagcttgcttccgttcaagttagcggcggacgggtgagtaacacgtgggtaacctgcctgtaagactgggataactccgggaaaccggggctaataccggatattctttttcttcgcatgaagaagaatggaaaggcggcttttaactgtcacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgtcagggaagaacaagtacggaagtaactgtccgtaccttgacggtacctgaccagaaagccacggctaactacgtgccagcagccgcggtaatacgtaggtggcaagcgttgtccggaattattgggcgtaaagcgcgcgcaggcggcttcttaagtctgatgtgaaagcccacggctcaaccgtggagggtcattggaaactgggaggcttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttggagggtttccgcccttcagtgctgcagctaacgcattaagcactccgcctggggagtacggccgcaaggctgaaactcaaaggaattgacgggggccgcacaagcggtggagcatgtggtttaattcgaagcaacgcgaagaaccttaccaggtcttgacatcccgctgaccggtctggagacaggcctttcttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcaaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaacacgagagtttgcaacacccgaagtcggtggggtaaccttacgggagcca

SEQ ID NO: 203 - DNA, 1389 bp, Bacillus cereus
tcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtg

SEQ ID NO: 204 - DNA, 1371 bp, Bacillus circulans
aagcttgcttttaaagttagcggcggacgggtgagtaacacgtgggcaacctgcctgtaagactgggataacttcgggaaaccggagctaataccggataatccttttcctctcatgaggaaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacaagagtaactgcttgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaaaaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagcaaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtg

SEQ ID NO: 205 - DNA, 1351 bp, Bacillus clausii
  modified_base (230)..(230): a, c, t, g, unknown or other
  modified_base (1341)..(1342): a, c, t, g, unknown or other
ggacgggtgagtaacacgtgggcaacctgccctttagactgggataactccgggaaaccggagctaataccggataatccctttctccacctggagagagggtgaaagatggcttcggctatcactaggggatgggcccgcggcgcattatctagttggtaaggtaacggcttaccaaggcaacgatgcgtacccgacctgagagggtgatcggccacactgggactganacacggcccagactcctacgggaggcagcagtagggaatcttccgcaatggacgaaagtctgacggagcaacgccgcgtgagtgaggaaggccttcgggtcgtaaagctctgttgtgagggaagaagcggtaccgttcgaatagggcggtaccttgacggtacctcaccagaaaccacggctaactacgtgccagcagccgcggtaatacgtaggtggcaagcgttgtccggaattattgggcgtaaagcgcgcgcagcggcttcttaagtctgatgtgaaatctcggggctcaaccccgagcggccattgaaactggggagcttgagtgcaaagagagagtggaattccacgtgtagcggtgaaatgcgtagagatgtggaggaacaccagtggcaggactctctggtctgtaactgacctgagcgcgaaagcgtggagcaaacagattaataccctggtagtccacgccgtaaacgatgagtgctagtgttaggggtttccatgcccgtagtgccaaagttaacacattaagcactccgcctggggagtacggccgcaaggctgaaactcaaaggaattgacggggacccgcacaagcagtggagcatgtggtttaattcgaagcaacgcgaagaaccttaccaggtcttgacatcctttgaccacccaagagattgggcttccccttcgggggcaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaaaccgcgaggtgaagccaatcccataaagccattctcagttcggattgcaggctgcaactcgcctgcatgaagccggaattgctagtaatcgcggatcagcatgccgcggtgaatacgttcccgggtcttgtacacaccgcccgtcacaccacgagagtttgtaacacccgaagtcggtgaggcaaccttnnggagccagc

SEQ ID NO: 206 - DNA, 1411 bp, Bacillus coagulans
  modified_base (10)..(10): a, c, t, g, unknown or other
tcgtgcggancttttaaagcttgcttttaaaaggttagcggcggacgggtgagtaacacgtgggcaacctgcctgtaagatcgggataacgccgggaaaccggggctaataccggatagttttttcctccgcatggaggaaaaaggaaagacggcttctgctgtcacttacagatgggcccgcggcgcattagctagttggtggggtaacggctcaccaaggcaacgatgcgtagccgacctgagagggtgatcggccacattgggactgagacacggcccaaactcctacgggaggcagcagtagggaatcttccgcaatggacgaaagtctgacggagcaacgccgcgtgagtgaagaaggccttcgggtcgtaaaactctgttgccggggaagaacaagtgccgttcgaacagggcggcgccttgacggtacccggccagaaagccacggctaactacgtgccagcagccgcggtaatacgtaggtggcaagcgttgtccggaattattgggcgtaaagcgcgcgcaggcggcttcttaagttgatgtgaaatcttgcggctcaaccgcaagcggtcattggaaactgggaggcttgagtgcagaagaggagagtggaattccacgtgtagcggtgaaatgcgtagagatgtggaggaacaccagtggcgaaggcggctctctggtctgtaactgacgctgaggcgcgaaagcgtggggagcaaacaggattagataccctggtagtcacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacctccctggagacagggccttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagccaatcccagaaaaccattcccagttcggattgcaggctgcaacccgcctgcatgaagccggaatcgctagtaatcgcggatcagcatgccgcggtgaatacgttcccgggccttgtacacaccgcccgtcacaccacgagagtttgtaacacccgaagtcggtgaggtaaccttacggagccagccg

SEQ ID NO: 207 - DNA, 1483 bp, Bacillus firmus
gacgaacgctggcggcgtgcctaatacatgcaagtcgagcggacggatgggagcttgctcacacgtcagcggcggacgggtgagtaacacgtgggcaacctgcctgtaagactgggataactccgggaaaccggggctaataccggataatgcttttcctcgcatgaggaaaagctgaaagatggcatctcgctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtaccggagtaactgccggtaccttgacggtacctgaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggttaagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaa

SEQ ID NO: 208 - DNA, 1529 bp, Bacillus flexus
gatcctggctcaggatgaacgctggcggcgtgcctaatacatgcaagtcgagcgaactgattagaagcttgcttctatgacgttagcggcggacgggtgagtaacacgtgggcaacctgcctgtaagactgggataactccgggaaaccggagctaataccggataacattttctcttgcataagagaaaattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggat

SEQ ID NO: 209 - DNA, 1462 bp, Bacillus fordii
gtgcctaatacatcgcaagtcgagcggatgaaagagagcttgctctctggattcagcggcggacgggtgagtaacacgtgggcaacctgcctgtaagactgggataactccgggaaaccggggctaataccggataacttcttttcccgcatggggagaggttgaaagacggttatgctgtcacttacagatgggcccgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggccttcgggtcgtaaaactctgttatcagggaagaacaagcatcgtttaactgacggtgccatgacggtacctgaccagaaagccacggctaactacgtgccagcagccgcggtaatacgtaggtggcaagcgttgtccggaattattgggccgtaaagcgcgcgcaggcggcttcttaagtctgatgtgaaagcccacggctcaaccgtggagggtcattggaaactgggaggcagttgtgcagaagaggagagcggaattccacgtgtagcggtgaaatgcgtaaagatgtggaggaacaccagtggcgaaggcggctctctggtctgtaactgacgctgaggcgcgaaagcgtgggtagcgaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccggtctggagacagatctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacagagggcagcgagaccgcgaggtggagcgaatcccttaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgccgaaggtgggacagatgattggggtgaagtcg

SEQ ID NO: 210 - DNA, 1485 bp, Bacillus gelatini
gacgaacgctggcggcgtgcctaatacatgcaagtcgagcggacggaaggagagcttgctctctggaagttagcggcggacgggtgagtaacacgtgggcaacctgcctcatagatggggataacaccgagaaatcggtgctaataccgaataatagagcggagcgcatgctccgcgcttgaaagtcggctttgagctgacactatgagatgggcccgcggcgcattagctagtaggtgaggtaacggctcacctaggcgacgatgcgtagccgacctgagagggtgatcggccacactgggactgagacacggcccagactcctacgggaggcagcagtagggaatcttcggcaatggacgaaagtctgaccgagcaacgccgcgtgagtgatgaaggttttcggatcgtaaaactctgttgtcagggaagaacaagtacgagagtaactgctcgtaccttgacggtacctgaccagaaagccacggctaactacgtgccagcagccgcggtaatacgtaggtggcaagcgttgtccggaattattgggcgtaaagcgcgcgcaggcggttctttaagtctgatgtgaaagcccacggctcaaccgtggagggtcattggaaactggggaacttgagtgcaggagagaaaagtggaattccacgtgtagcggtgaaatgcgtagagatgtggaggaacaccagtggcgaaggcggctttttggcctgtaactgacgctgaggcgcgaaagcgtggggagcaaacaggattagataccctggtagtccacgccgtaaacgatgagtgctaggtgttggggggttccaccctcagtgctgacgttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctctgaccacttgagagatcaagctttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggctgcgaaaccgcaaggtggagccaatcccaaaaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaa

SEQ ID NO: 211 - DNA, 1504 bp, Bacillus halmapalus
  modified_base (46)..(46): a, c, t, g, unknown or other
  modified_base (661)..(661): a, c, t, g, unknown or other
gacgaacgctggcggcgtgcctaatacatgcaagtcgagcggactnacacaagcttgcttttgtaagttagcggcggacgggtgagtaacacgtgggcaacctgcccttaagactgggataacttcgggaaaccggagctaataccggataatataaagaacctcctggttctttattgaaagatggtttcggctatcgcttatggatgggcccgcggcgcattagctagttggtgaggtaacggctcaccaagccaacgatgcgtagccgacctgagagggtgatcggccacactgggactgagacacggcccagactcctacgggaggcagcagtagggaatcttccacaatggacgaaagtctgatggagcaacgccgcgtgagtgatgaaggccttcgggtcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactggggaacttgagtgcagaagaggaaagtggaattccangtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgccaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggcagcaaaaccgcgaggtcgagccaatcccagaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtg

SEQ ID NO: 212 - DNA, 1457 bp, Bacillus halodurans
acgctggcggcgtgcctaatacatgcaagtcgagcggaccaaagggagcttgctcctggaggttagcggcgaacgggtgagtaacacgtgggcaacctgcctgtaagactgggataacatcgagaaatcggtgctaataccggataataaaaagaactgcatggttcttttttgaaagatggtttcggctatcacttacagatgggcccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccgttcgaaagggcggcaccttgacggtacctaacgagaaagccacggctaactacgtgccagcagccgcggtaatacgtaggtggcaagcgttgtccggaattattgggcgtaaagcgcgcgcaggcggtctcttaagtctgatgtgaaagcccccggctcaaccggggagggtcattggaaactgggagacttgagtacagaagaggagagtggaattccacgtgtagcggtgaaatgcgtagagatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgacgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctttgaccaccctagagatagggctttccccttcgggggacaaagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggttgcgaagccgcgaggtgaagccaatcccagaaagccattctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagat

SEQ ID NO: 213 - DNA, 1464 bp, Bacillus herbersteinensis
acgaacgctggcggcgtgcctaatacatgcaagtcgagcggacatttgagagcttgctctcaaatgttagcggcggacgggtgagtaacacgtgggtaacctgcctgtaagattgggataactccgggaaaccggagctaataccggataacattttgaaccgcatggttcgaaattgaaagatggctttcgrctatcacttacagatggacccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggcggttttttaagtctgatgtgaaagcccacggctcaaccgtggagggtcattggaaactggagaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcgaraccgcgaggttaagcgaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtggacagatgat

SEQ ID NO: 214 - DNA, 1512 bp, Bacillus horti
  modified_base (761)..(763): a, c, t, g, unknown or other
gacgaacgctggcggcgtgcctaatacatgcaagtcgagcgagtgaaactgacggaagccttcgggtggaagacagtggatctagcggcggacgggtgagtaacacgtaggcaacctgcctgtaagatggggataactccgggaaaccggagctaataccgaataatcgttttgctcgcatgagcaaaaggtgaaaggtggcgcaastaccgcttacagatgggcctgcggcgcattagctagttggtgaggtaacggctcaccaaggcgacgatgcgtagccgacctgagagggtgatcggccacactgggactgagacacggcccagactctacgggaggcagcagtagggaatcttcggcaatggacgaaagtctgaccgagcaacgccgcgtgagtgaagaaggttttcggattgtaaaactctgttgttagggaagaacaagtatcggttgaataagccggtaccctgacggtacctaacgagaaagccccggctaactacgtgccagcagccgcggtaatacgtagggggcaagcgttgtccggaattattgggcgtaaagcgcgcgcaggcggtctcttaagtctgatgtgaaagcccacggctcaaccgtggagggtcattggaaactgggagacttgagtgtaggagaggaaagcggaattccacgtgtagcggtgaaatgcgtagagatgtggaggaacaccagtggcgaaggcggctttctggcctataactgacgctgaggcgcgaaannntggggagcaaacaggattagataccctggtagtccacgccgtaaacgatgagtgctaggtgttaggggtttcgatacccttagtgccgacgctaacgcaataagcactccgcctggggagtacggccgcaaggctgaaactcaaaggaattgacggggacccgcacaagcagtggagcatgtggtttaattcgaagcaacgcgaagaaccttaccaggacttgacatccctctgaatcctctagagatagaggcgaccttcgggacagaggtgacaggtggtgcatggttgtcgtcagctcgtgtcgtgagatgttgggttaagtcccgcaacgagcgcaacccttaatcttagttgccagcattcagttgggcactctaaggtgactgccggtgacaaaccggaggaaggtggggatgacgtcaaatcatcatgccccttatgtcctgggctacacacgtgctacaatgggcagtacaaagggtagcgaagcgcgaggtggagccaatcccataaagctgctctcagttcggattgcaggctgcaactcgcctgcatgaagccggaattgctagtaatcgcggatcagcatgccgcggtgaatacgttcccgggtcttgtacacaccgcccgtcacaccacgagagtttgtaacacccgaagtcggtgaggtaaccttttggagccagccgcctaaggtgggatagatgattggggtgaagtcgtaacaaggtagccgtatcggaagg

SEQ ID NO: 215 - DNA, 1437 bp, Bacillus idriensis
cctaatacatgcaagtcgagcggacttgctggagcttgctccagcaggttagcggcggacgggtgagtaacacgtgggcaacctgcctgtaagactgggataactccgggaaaccggagctaataccggatagtatcttgaaccgcatggttcaagttggaaagacggtttcggctgtcacttacagatgggcccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctttgccacttctagagatagaaggttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaaccgcaaggagccagccagccgcctaagt

SEQ ID NO: 216 - DNA, 1535 bp, Bacillus lentus
agagtttgatcctggctcaggacgaacgctggcggcgtgcctaatacatgcaagtcgagcgaatggatgggagcttgctcccagaagttagcggcggacgggtgagtaacacgtgggcaacctacctgtaagactgggataacttcgggaaaccggagctaataccggataacttctttcttctcctggagaaaggttgaaagacggcttcggctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttatcagggaagaacaagtatcggagtaactgccggtaccttgacggtacctgaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggaaggtcattggaaactgggagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttagagggtttccgccctttagtgctgcagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaccaccctagagatagggacttccccttcgggggacagagtgacaggtggtgcatggttgtcgtcagctcgtgtcgtgagatgttgggttaagtcccgcaacgagcgcaacccttaaccttagttgccagcattcagttgggcactctaaggtgactgccggtgacaaaccggaggaaggtggggatgacgtcaaatcatcatgccccttatgacctgggctacacacgtgctacaatggatggtacaaagggttgcaagaccgcgaggtttagctaatcccataaaaccattctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagcgtatcggaaggtgcggtggatca

SEQ ID NO: 217 - DNA, 1548 bp, Bacillus licheniformis
ggagagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaataccggatgcttgattgaaccgcatggttccaatcataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttct

SEQ ID NO: 218 - DNA, 1404 bp, Bacillus megaterium
tcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaagg

SEQ ID NO: 219 - DNA, 878 bp, Bacillus nealsonii
  modified_base (121)..(121): a, c, t, g, unknown or other
gcggactttaaaagcttgcttttaaagttagcggcggacgggtgagtaacacgtgggcaacctgcctgtaagactgggataacttcgggaaaccggagctaataccggataattctttccnccacatggtggaaagctgaaagacggcatctcgctgtcacttacagatgggcccgcggcgcattagctagttggtgaggtaacggctcaccaaggcaacgatgcgtagccgacctgagagggtgatcggccacactgggactgaaacacggcccaaactcctacgggaggcagcagtagggaatcttccgcaatggacgaaagtctgacggagcaacgccgcgtgagtgatgaaggttttcggatcgtaaagctctgttgttagggaagaacaagtacaagagtaactgcttgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcaca

SEQ ID NO: 220 - DNA, 950 bp, Bacillus niabensis
  modified_base (37)..(37): a, c, t, g, unknown or other
  modified_base (43)..(43): a, c, t, g, unknown or other
  modified_base (80)..(80): a, c, t, g, unknown or other
  modified_base (85)..(85): a, c, t, g, unknown or other
  modified_base (939)..(939): a, c, t, g, unknown or other
gccagcagccgcggtaatacgtaggtggcaagcgttntccggnaattattgggcgtaaagcgcgcgcaggcggttccttnaagtntgatgtgaaagcccacggctcaaccgtggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacggggacccgcacaagcggtggagcatgtggtttaattcgaagcaacgcgaagaaccttaccaggtcttgacatcctctgctacttctagagatagaaggttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgtgaggtcgagccaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagtttgtaacacccgaagtcggtgaggtaacctttnggagccagccg

SEQ ID NO: 221 - DNA, 929 bp, Bacillus niacini
  modified_base (76)..(76): a, c, t, g, unknown or other
gccgcggtaatacgtaggtggcaagcgttgtccggaattattgggcgtaaagcgcgcgcaggcggtcctttaagtntgatgtgaaagctcacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagttcacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttacgacctccctagagatagggatttccccttcgggggacggaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgttacaatggatggtacaaagggcagcgaaaccgcgaggtcgagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaac

SEQ ID NO: 222 - DNA, 1495 bp, Bacillus pocheonensis
aggacgaacgctggcggcgtgcctaatacatgcaagtcgagcgaatcattaggagcttgctcctattggttagcggcggacgggtgagtaacacgtgggcaacctgcctgtaagactgggataacttcgggaaaccggagctaataccggataatccttttcctctcatgagggaaagttgaaagatggcgtcagctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgcaaggttaagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgt

SEQ ID NO: 223 - DNA, 1410 bp, Bacillus pumilus
  modified_base (1399)..(1399): a, c, t, g, unknown or other
tcgagcgaacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttanggagccagccg

SEQ ID NO: 224 - DNA, 1411 bp, Bacillus safensis
  modified_base (1400)..(1400): a, c, t, g, unknown or other
gtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacgtcctctgacaacctctgagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttanggagccagccg

SEQ ID NO: 225 - DNA, 1522 bp, Bacillus simplex
cctggctcaggacgaacgctggcggcgtgcctaatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaacctttatggaagccagccgcctaaggtgggacagatgattggggtgaagtcgtaacaaggtagccgtatcggaaggtgcggctgg

SEQ ID NO: 226 - DNA, 971 bp, Bacillus sonorensis
tcgagcgaaccgacgggagcttgctcccttaggttagcggcggacgggtgagtaacacgtgggtaacctgcctgtaagactgggataactccgggaaaccggggctaataccggatgcttgattgaaccgcatggttcaattataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaacagggcggtgccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacacccctagagatagggct

SEQ ID NO: 227 - DNA, 935 bp, Bacillus sp.
  10403023 MM10403188
  modified_base (843)..(843): a, c, t, g, unknown or other
  modified_base (926)..(926): a, c, t, g, unknown or other
tcgagcggagatttgaaaagcttgcttttcaaatcttagcggcggacgggtgagtaacacgtgggcaacctgcccttgagacggggataactccgggaaaccggagctaataccggataacacatatcttcgcatgaggatatgttagaaggtggcttttagctaccactcaaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtacctgttgaataagcaggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtanggtcgcaagactgaaactcaaaggaattgacggggacccgcacaagcggtggagcatgtggtttaattcgaagcaacgcgaanaaccttacc

SEQ ID NO: 228 - DNA, 1485 bp, Bacillus sp.
  2008724126
ggctcaggacgaacgctggcggcgtgcctaatacatgcaagtcgagcgaatcgaygggagcttgctccctgagattagcggcggacgggtgagtaacacgtgggcaacctgcctataagactgggataacttcgggaaaccggagctaataccggatacgttcttytctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaggtgggacagatgattggggtgaagtc

SEQ ID NO: 229 - DNA, 1495 bp, Bacillus sp.
  2008724139
gttgatcctggctcaggacgaacgctggcggcgtgcctaatacatgcaagtcgagcgaatcgacgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttyatggagccagccgcctaaggtgggacagatgattggggtgaagtcg

SEQ ID NO: 230 - DNA, 1547 bp, Bacillus sp.
  2_A_57_CT2
ggagagtttgatcctggctcaggacgaacgctggcggcgtgcctaatacatgcaagtcgagcggacagatgggagcttgctccctgaagtcagcggcggacgggtgagtaacacgtgggcaacctgcctgtaagactgggataactccgggaaaccggggctaataccggataattctttccctcacatgagggaaagctgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttct

SEQ ID NO: 231 - DNA, 1493 bp, Bacillus sp.
  7-16AIA
tggctcaggacgaacgctggcggcgtgcctaatacatgcaagtcgagcggatgacgaggagcttgctcctctgattcagcggcggacgggtgagtaacacgtgggcaacctgcctgtaagactgggataactccgggaaaccggggctaataccggataggtgatgtcttcgcatgaagagatcaggaaagatggcttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgttagggaagaacaagtaccgttcgaatagggcggtaccgtgacggtacctaaccagaaagccacggctaactacgtgccagcagccgcggtaatacgtaggtggcaagcgttgtccggaattattgggcgtaaagcgcgcgcaggcggcttcttaagtctgatgtgaaagcccgcagctcaactgcggagggtcattggaaactgggaagcttgagtgcagaagaggagagtggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgctacttctagagatagaaggttccccttcgggggacggagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggacggtacaaagggctgcgaaaccgcgaggtggagccaatcccagaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccgcaaggagccagccgccgaaggtgggacagatgattggggtgaagtcgtaacaa

SEQ ID NO: 232 - DNA, 1503 bp, Bacillus sp.
  9-3AIA
tggcaggacgaacgctggcggcgtgcctaatacatgcaagtcgagcgagtgaaacgatcagaagccttcgggtggacgatcgtggatctagcggcggacgggtgagtaacacgtaggcaacctgcctgtaagacggggataactccgggaaaccggagctaataccggatgaaccttcagctcgcatgagctggagttgaaaggtggcgcaagctaccacttacagatgggcctgcggcgcattagctagttggtgaggtaagggctcaccaaggcgacgatgcgtagccgacctgagagggtgatcggccacactgggactgagacacggcccagactcctacgggaggcagcagtagggaatcttcggcaatggacgcaagtctgaccgagcaacgccgcgtgagtgaggaaggttttcggattgtaaaactctgttgttagggaagaacaagtaccgtttgaataaggcggtaccttgacggtacctaacgagaaagccccggctaactacgtgccagcagccgcggtaatacgtagggggcaagcgttgtccggaattattgggcgtaaagcgcgcgcaggcggtttcttaagtctgatgtgaaagcccacggctcaaccgtggagggtcattggaaactgggaaacttgagtgtaggagaggaaagcggaattccacgtgtagcggtgaaatgcgtagagatgtggaggaacaccagtggcgaaggcggctttctggcctataactgacgctgaggcgcgaaagcgtggggagcaaacaggattagataccctggtagtccacgccgtaaacgatgagtgctaggtgttaggggtttcgatacccttagtgccgacgttaacacaataagcactccgcctggggagtacggccgcaaggctgaaactcaaaggaattgacggggacccgcacaagcagtggagcatgtggtttaattcgaagcaacgcgaagaaccttaccaggacttgacatccctctgaatcctctagagatagaggcggccttcgggacagaggtgacaggtggtgcatggttgtcgtcagctcgtgtcgtgagatgttgggttaagtcccgcaacgagcgcaacccttaatcttagttgccagcattcagttgggcactctaaggtgactgccggtgacaaaccggaggaaggtggggatgacgtcaaatcatcatgccccttatgtcctgggctacacacgtgctacaatgggcagtacaacgggtagcgaagccgtgaggtggagccaatcccataaagctgctctcagttcggattgcaggctgcaactcgcctgcatgaagccggaattgctagtaatcgcggatcagcatgccgcggtgaatacgttcccgggtcttgtacacaccgcccgtcacaccacgagagcttgtaacacccgaagtcggtgaggtaaccttttggagccagccgccgaaggtgggataggtgattggggtgaagtcgtaacaa

SEQ ID NO: 233 - DNA, 1514 bp, Bacillus sp.
  AP8
tagagtttgatcctggctcaggacgaacgctggcggcgtgcctaatacatgcaagtcgagcgaacggaggagagcttgctctccgaagttagcggcggacgggtgagtaacacgtgggcaacctgcctataagactgggataactccgggaaaccggggctaataccggatagttcttttctccwcatggagaaaaggggaaagatggtttcggctatcacttatagatgggcccgcggcgcattagctagttggtagggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggaaggtcattggaaactggggaacttgagtgcagaagaggaaagtggaattccaagtgtagcggtgaaatgcgtagatatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgccactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaaaccgcgaggtttagccaatcccataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgcaaggagccagccgcctaaggtgggacagatgattggggtgaagtcgtaacaaggtagccgt

SEQ ID NO: 234 - DNA, 1402 bp, Bacillus sp.
  B27(2008)
  modified_base (1389)..(1389): a, c, t, g, unknown or other
agcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagttgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtanccttttaggagcc

SEQ ID NO: 235 - DNA, 1411 bp, Bacillus sp.
  BT1B_CT2
  modified_base (1400)..(1400): a, c, t, g, unknown or other
gtcgagcggaccgacgggagcttgctcccttaggtcagcggcggacgggtgagtaacacgtgggtaacctgcctgtaagactgggataactccgggaaaccggggctaataccggatgcttgtttgaaccgcatggttcaaacataaaaggtggcttttcgctaccacttacagatggacccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaacagggcggtaccttgacggtacctaaccagaaagccacggctaactacgtgccagcagccgcggtaatacgtaggtggcaagcgttgtccggaattattgggcgtaaagcgcgcgcaggcggtttttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttnggagccagccg

SEQ ID NO: 236 - DNA, 1429 bp, Bacillus sp.
  GB1.1
ggggaggagagggactgctcctgagtcagcggcggacgggtgagtaacacgtgggcaacctgcctgtaagactgggataacttcgggaaaccggagctaataccggataatgcacagcctctcatgaggctatgctgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtgccggagtaactgccggcaccttgacggtacctgaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattaggttgggcactctaaggtgactgccggtgacaaaccggaggaaggtggggatgacgtcaaatcatcatgccccttatgacctgggctacacacgtgctacaatggatggtacaaagggctgcaagaccgcgaggttaagcgaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaacctttggagccagccgcctaaggtggacagagatgggatcctt

SEQ ID NO: 237 - DNA, 1218 bp, Bacillus sp.
  GB9
  modified_base (1162)..(1162): a, c, t, g, unknown or other
ggggggagagaagggactgctcctgagtcagcggcggacgggtgagtaacacgtgggcaacctgcctgtaagactgggataactccgggaaaccggggctaataccggataattctttccctcacatgagggaaagctgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgngctacacacgtgctacaatggatggtacaaagggctgcgagaccgcgaggtaagcg

SEQ ID NO: 238 - DNA, 1413 bp, Bacillus sp.
  HU19.1
agctcttcggagatcagcggcggacgggtgagtaacacgtgggcaacctgcctgtaagactgggataactccgggaaaccggagctaataccggatactatgtcaaaccgcatggtttgacattcaaagacggtttcggctgtcacttacagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtgccggagtaactgccggcgccttgacggtacctgaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctttgccacttctagagatagaaggttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaaccgcaaggagccagccgcctaaggtggggtagattgatc

SEQ ID NO: 239 - DNA, 1428 bp, Bacillus sp.
  HU29
acggaagggagcttgctcatacgtcagcggcggacgggtgagtaacacgtgggcaacctgcctgtaagactgggataactccgggaaaccggggctaataccggataatgcttttcctcacatgagggaaagctgaaagatggcttctcgctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggttaagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattgggat

SEQ ID NO: 240 - DNA, 1418 bp, Bacillus sp.
  HU33.1
gatcgctttggagtcagcggcggacgggtgagtaacacgtgggcaacctgcctgtaagactgggataactccgggaaaccggagctaataccggatactatgtcaaaccgcatggtttgacattcaaagacggtttcggctgtcacttacagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtgccggagtaactgccggcgccttgacggtacctgaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctttgccacttctagagatagaaggttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaaccgcaaggagccagccgcctaaggtggggtagatgattgggatg

SEQ ID NO: 241 - DNA, 1475 bp, Bacillus sp.
  JC6
tagagttttgatcctggctcaggacgaacgctggcggcgtgcctaatacatgcaagtcgagcggatctgagggagcttgctcccaaagattagcggcggacgggtgagtaacacgtgggcaacctgcctataagactgggataacttcgggaaaccggagctaataccggataatgcttttggacacatgtccggaagctgaaagatggcttctcgctatcacttatagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggttctttaagtctgatgtgaaagcccccggctcaaccggggagggtcattggaaactggggaacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttatgccatccctagagatagggctttcccttcggggacataagtgacaggtggtgcatggttgtcgtcagctcgtgtcgtgagatgttgggttaagtcccgcaacgagcgcaacccttgatcttagttgccagcattgagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagcgaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaagg

SEQ ID NO: 242 - DNA, 1525 bp, Bacillus sp.
  SRC_DSF10
agagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataactccgggaaaccggagctaataccggataacattttctcttgcataagagaaaattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagctcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtaaccgtagcggccgc

SEQ ID NO: 243 - DNA, 934 bp, Bacillus sp.
  SRC_DSF1
  modified_base (76)..(76): a, c, t, g, unknown or other
  modified_base (233)..(233): a, c, t, g, unknown or other
gccgcggtaatacgtaggtggcaagcgttatccggaattattgggcgtaaagcgcgcgcaggcggtttcttaagtntgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgntgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaagg

SEQ ID NO: 244 - DNA, 1526 bp, Bacillus sp.
  SRC_DSF2
agagtttgatcatggctcaggatgaacgctggcggcgtgcctaatacatgcaagtcgagcgaactgattagaagcttgcttctatgacgttagcggcggacgggtgagtaacacgtgggcaacctgcctgtaagactgggataactccgggaaaccggagctaataccggataacattttctcttgcataagagaaaattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcattccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccaggccttgtacacaccgcccgtcacaccacgagagtttgtaacacccgaagtcggtggggtaacctttatggagccagccgcctaaggtgggacagatgattggggtgaagtcgtaacaaggtaaccgtagcggccgc

SEQ ID NO: 245 - DNA, 1525 bp, Bacillus sp.
  SRC_DSF6
agagtttgatcatggctcaggatgaacgctggcggcgtgcctaatacatgcaagtcgagcgaactgattagaagcttgcttctatgacgttagcggcggacgggtgagtaacacgtgggcaacctgcctgtaagactgggataactccgggaaaccggagctaataccggataacattttctcttgcataagagaaaattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagctacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcattccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtaaccgtagcggccgc

SEQ ID NO: 246 - DNA, 1552 bp, Bacillus sp.
  oral taxon F26
agagtttgatcctggctcaggacgaacgctggcggcgtgcctaatacatgcaagtcgagcggagatttaaaagcttgcttttaaatcttagcggcggacgggtgagtaacacgtgggcaacctgccctgtagactgggataacttcgggaaaccgaagctaataccggataatcgaagggacctcatggttctttagtaaaagttgggtttacctaacactacaggatgggcccgcgtcgcattagctagttggtagggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtactgttcaaatagggcagtaccttgacggtacctaacgagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatccccatgacctctctagagatagagatttcccttcggggacatgggtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagccaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaacctaagagtttgcggagcaatcttgcttcgtaagcgttgacctaggagccagccgcctaaggtgggacagatgattggggtgaagtcgtaacaaggtagccgt

SEQ ID NO: 247 - DNA, 1478 bp, Bacillus sp.
  oral taxon F28
agagtttgatcctggctcaggacgaacgctggcggcgtgcctaatacatgcaagtcgagcgcgggaagcttgcggaatccttcgggaggaagtgagcggaccgagcggcggacgggtgagtaacacgtgggcaacctgcccgtaagacggggataaccccgggaaaccggggctaataccggataggtgacctttctgcatggaggggtcatgaaaggcggcggaagccgtcgcttacggaggggcccgcggcgcattagctagttggtgagggaagggctcaccaaggcgacgatgcgtagccggcctgagagggtgaacggccacactgggactgagacacggcccagactcctacgggaggcagcagtagggaatcttccgcaatggacggaagtctgacggagcaacgccgcgtgagtgaggaaggccttcgggtcgtaaagctctgttgttcgtgaagaaggggttggccaggaaatgggccgacattgacggtagcgaaccagaaagccccggctaactacgtgccagcagccgcggtaacacgtagggggcaagcgttgtccggaatgattgggcgtaaagggcgcgcaggcggcctcttaagtctgatgtgaaagcccacggctcaaccgtggagggacattggaaactggggggcttgagtgcaggagaggggagtggaattccacgtgtagcggtgaaatgcgtagagatgtggaggaacaccagtggcgaaggcggctctctggcctgtgactgacgctgaggcgcgaaagcgtggggagcgaacaggattagataccctggtagtccacgccgtaaacgatgagtgctaggtgttaggggggagcaccccttagtgctgaagtcaacacattaagcactccgcctggggagtacgaccgcaaggttgaaactcaaaggaattgacgggggcccgcacaagcagtggagcatgtggtttaattcgaagcaacgcgaagaaccttaccaggtcttgacatccctctgatgggttcagagatggaccgttccttcgggacagaggagacaggtggtgcatggttgtcgtcagctcgtgtcgtgagatgttgggttaagtcccgcaacgagcgcaacccttgacctttgttgccagcattaagttgggcactcagaggtgactgccggtgacaaaccggaggaaggtggggatgacgtcaaatcatcatgcccctgatgacctgggcgacacacgtgctacaatgggcggtacagagggcagcgaagccgcgaggcggagcgaatcccagaaagccgctctcagttcggattgcaggctgcaactcgcctgcatgaaggaggaattgctagtaatcgcggatcagcatgccgcggtgaatccgttcccgggccttgtacacaccgcccgtcacaccacgagagtctgtaacacccgaagtcggtgaggcaaccggaaggagccagccgcc

SEQ ID NO: 248 - DNA, 1507 bp, Bacillus sp.
  oral taxon F79
  modified_base (880)..(880): a, c, t, g, unknown or other
agagtttgatcctggctcaggacgaacgctggcggcgtgcctaatacatgcaagtcgagcgcttgcatattgaaagcttgctttcaatatgcttgagcggcggacgggtgagtaacacgtgggcaacctgcctgtaagactgggataacttcgggaaaccggagctaataccggataatgcttttgaacacatgttcgaaagctgaaagatggtttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccccggctcaaccggggagggtcattggaaactgggagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaancactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaa

SEQ ID NO: 249 - DNA, 1405 bp, Bacillus sp.
  tc09
tgcagtcgagcgaatggattaagagcttgctcttatgaagttagcggcggacgggtgagtaacacgtgggtaacctgcccataagactgggataactccgggaaaccggggctaataccggataacattgaaccgcatggttcgaaattgaaaggcggcttcggctgtcacttatggatggacccgcgtcgcattagctagttggtgaggtaacggctcaccaaggcaacgatgcgtagccgacctgagaggggtcggccacactgggactgagacacggcccagactcctacgggaggcagcagtagggaatcttccgcaatggacgaaagtctgacggagcaacgccgcgtgagtgatgaaggctttcgggtcgtaaacctgttgttagggaagaacaagtgctagttgaataagctggcaccttgacggtacctaaccagaaagccacggctaactacgtgccagcagccgcggtaatacgtaggtggcaagcgttatccggattttgggcgtaaagcgcgcgcaggtggtttcttaagtctgatgtgaaagcccacggctcaaccgtggagggtcattggaaactgggagacttgagtgcagaagaggaaagtggaattccatgtgtgcgggaaatgcgtagagatatggaggaacaccagtggcgaaggcgactttctggtctgtaactgacactgaggcgcgaaagcgtggggagcaaacaggattagataccctggtagtccacgccgtaacgatagtgctaagtgttagagggtttccgccctttagtgctgaagttaacgcattaagcactccgcctggggagtacggccgcaagggtgaaacttaaaggaattgacgggggcccgcaccagcgtggagctgtggtttaatttgaagcaacgggaagaaccttaccaggttttgacatcctttgacaaccctagagataggggttttcctttgggagcagagtgacaggtggtgcatggttgttgtcagccgtgttggagatgttgggttaagtcccgcaacgagcgcaacccttgattttagttgccatcattaagttgggcactttaaggtgactgccggtgacaaaccggaggaaggtggggaagacgtcaaacatcatgcccttatgacctgggctacccacgtggtacaatggacggtacaaagaggtgcaagaccccgagggggagctaatttcataaaaccgttttcagtttggattgtagggtgcaacttgcctcatgaagccgaatcgctagtaatcgcggatcagcctgccgcggggaatacgttcccgggccttgtacaccccccccgtcaccccccgagagtttgtaacacccgaagtcggtggggtaacctttttgagccagccgctaaggtg

SEQ ID NO: 250 - DNA, 725 bp, Bacillus sp.
  zh168
  modified_base (105)..(106): a, c, t, g, unknown or other
  modified_base (112)..(112): a, c, t, g, unknown or other
  modified_base (134)..(135): a, c, t, g, unknown or other
cttcggctaccacttacagatggacccgcggcgcattagctagttggtgaggtaacggctcaccaaggcaacgatgcgtagccgacctgagagggtgatcggccnnactggnactgagacacggcccagactcnnacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcc

SEQ ID NO: 251 - DNA, 1430 bp, Bacillus sphaericus
taatacatgcaagtcgagcgaacagagaaggagcttgctcctttgacgttagcggcggacgggtgagtaacacgtgggcaacctaccttatagtttgggataactccgggaaaccggggctaataccgaataatctgtttcacctcatggtgaaatattgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatggtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccga

SEQ ID NO: 252 - DNA, 1497 bp, Bacillus sporothermodurans
ctggcggcgtgcctaatacatgcaagtcgagcgaacttgatgggagcttgctccctgagagttagcggcggacgggtgagtaacacgtgggtaacctgcctgtaagactgggataactccgggaaaccggggctaataccggataacttttttcttcgcatgaaggagaattgaaagacggctttaagctaccacttacagatggacccgcggcgcattagctagttggtgaggtaacggctcaccaaggcgacgatgcgtagccgacttgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctcttgacctccctagagatagggatttcccttcggggacaagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggttgctagaccgcgaggttacgccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaag

SEQ ID NO: 253 - DNA, 965 bp, Bacillus subtilis
  modified_base (857)..(857): a, c, t, g, unknown or other
  modified_base (919)..(919): a, c, t, g, unknown or other
  modified_base (929)..(929): a, c, t, g, unknown or other
  modified_base (938)..(938): a, c, t, g, unknown or other
ggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacnggggcccgcacaagcggtggagcatgtggtttaattcgaagcaacgcgaagaacccttaccnggtcttgacntcctctganatcctagagataggacgtccccttcgg

SEQ ID NO: 254 - DNA, 1412 bp, Bacillus thermoamylovorans
tcgagcgaaccaataagaagcttgctttttgttggttagcggcggacgggtgagtaacacgtgggtaacctgcctgtaagaccgggataactccgggaaaccggtgctaataccggatagattatctttccgcctggagagataaggaaagatggcttttgccatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgttagggaagaacaagtatcggaggaaatgccggtaccttgacggtacctgacgagaaagccacggctaactacgtgccagcagccgcggtaatacgtaggtggcaagcgttgtccggatttattgggcgtaaagcgcgcgcaggcggtcctttaagtctgatgtgaaatcttgcggctcaaccgcaagcggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatctcctgaccgccctggagacagggtcttcccttcggggacaggatgacaggtggtgcatggttgtcgtcagctcgtgtcgtgagatgttgggttaagtcccgcaacgagcgcaacccttggttctagttgccagcattcagttgggcactctagagcgactgccggcgacaagtcggaggaaggtggggatgacgtcaaatcatcatgccccttatgacctgggctacacacgtgctacaatggatggtacaaagggcagcgaagcggcgacgcatgagcgaatcccagaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccgtaaggagccagccg

SEQ ID NO: 255 - DNA, 1554 bp, Bacillus thuringiensis
ttattggagagtttgatcctggctcaggatgaacgctggcggcgtgcctaatacatgcaagtcgagcgaatggattaagagcttgctcttatgaagttagcggcggacgggtgagtaacacgtgggtaacctgcctataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttct

SEQ ID NO: 256 - DNA, 1545 bp, Bacillus weihenstephanensis
agagtttgatcctggctcaggatgaacgctggcggcgtgcctaatacatgcaagtcgagcggatggattaagagcttgctcttatgaagttagcggcggacgggtgagtaacacgtgggtaacctacccataagactgggataactccgggaaaccggggctaataccggataatattttgaactgcatagttcgaaattgaaaggcggcttcggctgtcacttatggatggacccgcgtcgcattagctagttggtgaggtaacggctcaccaaggcgacgatgcgtagccgacctgagagggtgatcggccacactgggactgagacacggcccagactcctacgggaggcagcagtaggggatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaactctagagatagagcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctccttt

SEQ ID NO: 257 - DNA, 1388 bp, Bacteroidales bacterium ph8
gcagcatgaaagtagcaatacttttgatggcgaccggcggacgggtgcgtaacgcgtatgcaacctaccctttacagggggataacactgagaaatcggtactaataccccataatattccgggaggcatctttcggagttgaaagctttggtggtaaaggatgggcatgcgttgtattagctagttggtaaggtaacggcttaccaaggcgacgatacatagggggactgagaggttaaccccccacattggtactgagacacggaccaaactcctacgggaggcagcagtgaggaatattggtcaatggacggaagtctgaaccagccatgccgcgtgcaggaagacggctctatgagttgtaaactgcttttgtacgagggtaaacgcagatacgtgtatctgcctgaaagtatcgtacgaataaggatcggctaactccgtgccagcagccgcggtaatacggaggatccaagcgttatccggatttattgggtttaaagggtgcgtaggcggtttagtaagtcagcggtgaaattttggtgcttaacaccaaacgtgccgttgatactgctgggctagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgatagctcgttgtcggcgatacacagtcggtgactaagagaaatcgataagctatccacctggggagtacgttcgcaagaatgaaactcaaaggaattgacgggggcccgcacaagcggaggaacatgtggtttaattcgatgatacgcgaggaaccttacccgggcttgaaagttactgacgattctggaaacaggatttcccttcggggcaggaaactaggtgctgcatggttgtcgtcagctcgtgccgtgaggtgtcgggttaagtcccataacgagcgcaacccctactgatagttgccatcagagcgtttgagcgatcaaacaagctgggcactctatcgggactgccggtgtaagccgagaggaaggtggggatgacgtcaaatcagcacggcccttacgtccggggcgacacacgtgttacaatggtaggtacagagggcagccacccagtgatggggagcgaatctcgaaagcctatctcagttcggattggaggctgaaactcgcctccatgaagttggattcgctagtaatcgcgcatcagccatggcgcggtgaatacgttcccgggccttgtacacaccgcccgtcaagccatgggagttgggggtgcctgaagttcgtgaccgag

SEQ ID NO: 258 - DNA, 1285 bp, Bacteroidales sp.
  P1
atgaacgctagcggcaggcttaacacatgcaagtcgagggaccggcgtaagggtgcgtaacgcgtgagcaacctgcccgtatcagggggataaccgatggaaacgtcgcctaataccccataataaaagtcagatacggatgggctcgcgtgacattagctagttggtgtggtaacggcacaccaaggcaacgatgtctaggggttctgagaggaagaccccccacactggaactgagacacggtccagactcctacgggaggcagcagtgaggaatattggtcaatgggcggaagcctgaaccagccatgccgcgtgaaggaataaggtctatggatcgtaaacttcttttgagcgggagcatgagagtaccgttcgaataagcatcggctaactccgtgccagcagccgcggtaatacggaggatgcaagcgttatccggatttattgggtttaaagggtgcgtaggccgttgtgcaagtcagaggtgaaatcgcggggctcaaccccgtgtctgcctttgatactgtatgacttgaatgttgttgccgtgtgaggaatgagtagtgtagcggtgaaatgcatagatattactcagaacaccgattgcgaaggcatctcacgaaacaaattgacgctgaggcacgaaagcgtgggtatccaacaggattagataccctggtagtccacgctgtaaacgatgataactaaccgtcggcgagtcggtggccaagcgaaagcgataagttatccacctggggagtacgaccgcaaggttgaaactcaaaggaattgacgggggcccgcacaagcggaggaacatgtggtttaattcgatgatacgcgaggaaccttacccgggctcgaacggtcgaggtgctgcatggttgtcgtcagctcgtgtcgtgagatgttggctcaagtgccataacgagcgcaacccttgtcattagttgccatcggccgggctctctaatgagactgccaccgcaaggtggaggaaggagtggatgacgtcaaatcagcacggcccttacgtccggggcgacacacgtgttacaatggtgaccagagggtagccagccggcgacggcgcgcaaatctcagtcatctcagttcggatggagtctgcaacccgactccagaagctggattcgctagtaatcgcgcatcagccatggtgcggtgaatacgttcccgggccttgtacacaccgcccgtcaagccatgaaagccgagggcgcctgaagtccggccggcctaaggcgaacttggtaattggggc

SEQ ID NO: 259 - DNA, 1289 bp, Bacteroidales sp.
  P2 oral clone MB1_G13
gatgaacgctagcggcaggcttaacacatgcaagtcgagggaccggcgaaagggtgcgtaacgcgtgagtaacatacccgttacagagggatagtcgatggaaacgtcgtataatacctcatagttaaatgaggtaacggagtggctcgcgtcccattagttagttggcgtggtaacggcacaccaagacaacgatgggtaggggttctgagaggaaggtcccccacactggaactgagacacggtccagactcctacgggaggcagcagtgaggaatattggtcaatgggcggaagcctgaaccagccatgccgcgtgcaggaatagatcctatgggacataaactgcttttgatactgagcatgagagtaagtatcgaataagcatcggctaactccgtgccagcagccgcggtaatacgggggatgcaagcgttatccggaattattgggtttaaagggtgcgtaggctgtgcggtgcgtctgtggttaaaggcctctgcttaacggagcgtatgccatagaaacggccgtgcttgagagtgattgccgtgggaggaatgtgtggtgtagcggtgaaatgcatagatatcacacagaacaccgattgcgaaggcatctcacgaagtcatctgacgctgaagcacgaaagcgtgggaatcaaacaggattagataccctggtagtccacgctgtaaacgatgataactaaccgccggcgatcggtggctaagcgaaagcgataagttatccacctggggagtacgaccgcaaggttgaaactcaaaggaattgacgggggcccgcacaagcggaggaacatgtggtttaattcgatgatacgcgaggaaccttacccgggctcgaacggtcgaggtgctgcatggttgtcgtcagctcgtgccgtgaggtgtcggcttaagtgccataacgagcgcaacccttgcctgctgttaccaacgtacggggactcagcagggactgccaccgtaaggtggaggaagggggggatgacgtcaaatcagcacggcccttacgtccggggcgacacacgtgtcacaatggcggtcagagagttgcttgacagtgatgtttggctaatctataccgtctcagttcggatggagtctgcaacccgactccagaagctggattcgctagtaatcgcgcatcagccatggcgcggtgaatacgttcccgggccttgtacacaccgcccgtcaagccatggaagtcattggcgcctgaagcttgtccgagcgagcgaaggcgaaaatggtaactggggc

SEQ ID NO: 260 - DNA, 1282 bp, Bacteroidales sp.
  P3 oral clone MB1_G34
  modified_base (908)..(908): a, c, t, g, unknown or other
gatgaacgcttgcggcaggcataatacatgcaagtcgaacgagtggcggatgggtgagtaacgcgtatgcaacctacctcacaccgagaacaagcgactgaaaagttgaatatctcgtgatgatagttggtgtgagatgggcatgcgtatcattagctagttggcggggtaatagcccaccaaggcgacgatgattcgggggcctgagagggtggtcccccacactgggactgagacacggcccagactcctacgggaggcagcagtagggaatatcggtcaatgggcggaagcctgaaccagccatgccgcgtgatggatgacggccttagggttgtaaacatcttttctactagaggacgactgtatagtaggaataaggatcggctaactccgtgccagcagccgcggtaatacggaggattcgagcgttatccggatttactgggtttgaagggtgcgcaggcgggctcttaagtcagcggtgaaatgtccgggcttaccctgggccttgccgttgatactgggagtcttggataagataaggacggcggaatgcgtagtgtagcggtgaaatgcttagatattacgtagaagaccgattgcgaaggcagctgtctgggtctatcgacgctcaagcacgaaagcgtgggtagcgaacaggattagataccctggtagtccacgccgtaaacgatgatcactcgctcttggcgtgtcaggggctaagcgaaagcgttaagtgatccacctggggagtacgaccgcaaggttgaaactcaaaggaattgacgggggcccgcacaagcggaggaacatgtggtttaattcgatgatacgcgaggaaccttacctgggctagaacggtcgaggtgctgcatggttgtcgtcagctcgtgccgtgaggngtcgggttaagtcccataacgagcgcaacccttatcgtcagttaccatcaattggggactctggcgagactgccggtgcaaaccggaggaaggtggggatgacgtcaaatcagcacggcccttacgtccagggcgacacacgtgttacaatgggtagcggagagttgccagccagcgatggtgagctaatctatctatcctcagttcggacggagtctgcaactcgactccggaagctggattcgctagtaatcgcgcatcagccatggcgcggtgaatacgttcccgggccttgtacacaccgcccgtcaagccatgaaagtcatgggtgcctgaagttcgtcgcaacctagggcaaacttggtgattagggc

SEQ ID NO: 261 - DNA, 1286 bp, Bacteroidales sp.
  P4 oral clone MB2_G17
gatgaacgcttgcggcaggcttaatacatgcaagtcgaacgagtggcggatgggtgagtaacgcgtatgcaacctacctcgtgtcgagaaaaagtcgactgaaaagtcgattaaagtttcgtagtgatagttggcgcgagatgggcatgcgtatcattagctagttggtagggtaacggcctaccaaggcgacgatgattaggggttctgagagggaggtcccccacactgggactgagacacggcccagactcctacgggaggcagcagtagggaatattggtcaatgggcggaagcctgaaccagccatgccgcgtgatggacgacggccttcgggttgtaaacatcttttctgctagaggatgactgtatagcaggaataaggatcggctaactccgtgccagcagccgcggtaatacggaggatccgagcgttatccggatttactgggtttaaagggtgcgcaggcgggctcttaagtcagtggtgaaaagcctaggcttaccctaggtcgtgccattgatactgggagtcttggataagataaggaaggcggaatgcgtagtgtagcggtgaaatgcttagatattacgtagaagaccgattgcgaaggcagctttctgggtctatcgacgctcaagcacgaaagcgtgggtagcgaacaggattagataccctggtagtccacgccgtaaacgatgatcactcgctcttggcgtgtcaggggccaagcgaaagcgttaagtgatccacctgggagtacggccgcaaggctgaaactcaaaggaattgacgggggcccgcacaagcggaggaacatgtggtttaattcgatgatacgcgaggaaccttacctgggctagaactgcagaggtgctgcatggttgtcgtcagctcgtgccgtgaggtgtcgggttaagtcccataacgagcgcaacccctatcgtcagttaccatcagctggggactctggcgagactgccggtgcaaaccggaggaaggtggggatgacgtcaaatcagcacggcccttacgtccagggcgacacacgtgttacaatgggtagcagcgagttgccaaccagcaatggtgcgctaatctatactaccctcagttcggacggagtctgcaactcgactccggaagctggattcgctagtaatcgcgcatcagccatggcgcggtgaatacgttcccgggccttgtacacaccgcccgtcaagccatgaaagtcgtgggtgcctgaagttcgtagcgacctaaggcaaactcaatgattagggc

SEQ ID NO: 262 - DNA, 1265 bp, Bacteroidales sp.
  P5 oral clone MB2_P04
gcataacacatgcaagtcgagggaccggcggatgggtgagtagcgcgtacgtaacctaccttgtacagtgggataggcattggaaacggtgtataataccacgtaatggaagttggtataagatgggcgtgcgtaggattagatagatggtagggtaaaggcttaccatgtctatgatctttaggggttctgagaggaaggtcccccacattgcaactgagatacggtgcaaactcttacgggaggcagcagtgaggaatattggtcaatgggcggaagcttgaaccagccataccgcgtgcaggaaggcggcctatgggttgtaaactgcttttatatttgaataggaaattagggtacgaataagtatcggctaactccgtgccagcagccgcggtaatacggaggatacgagcgttgtccggatttattgggtttaaagggtgcgtaggcggttaattaggtctatggtaaaatagttatgcttaacatgattatgctgtggataccggttggctagaatataagtggcgtaggcggaatgaagcgagtagaggtgacattcatagatatgctttggaacaccgttcgcgtaggcggcttacgataattgacgctgaggcacgagagcgtgggtatcgaacagaattagatactctggtagtccacgctgtaaacgatgataactatatgtcggcgtgtcggtgtaggagtgaaagcgataagttatccacctggggagtacgattgcaaggttgaaactcaaaggaattgacgggggcccgcacaagcggaggagcatgtggtttaattcgatgatacgcgaggaaccttacccgggcttgaacgtgcgaggtgctgcatggttgtcgtcagctcgtgccgtgaggtgtcaggttaagtcctataacgagcgtaacccttgttgatagttaccagcgcgtggggactctattgatactgccggtgtaagccggaggaagggggggatgacgtcaaatcagcacggcccttacgtccggggcgacacacgtgctacaatggttaacagagggcagttatacagagatgtaacacgaatctttttagtcatagtacggatggagtctgcaactcgacttcagaagatggattcgctagtaatcgcagatcagccatgctgcggtgaatacgttcccgggccttgtacacaccgcccgtcaagccatgggagttggtggtacctaaagagcgtagcgtttaagggtaatgctaataactggggc

SEQ ID NO: 263 - DNA, 1287 bp, Bacteroidales sp.
  P6 oral clone MB3_C19
gatgaacgcttgcggcaggcttaatacatgcaagtcgaacgagtggcggatgggtgagtaacgcgtatgcaaccttcctcacaccgagaaaaagtcgactgaaaagttgaataaagtctcgtgatgatagttggtgtgagatgggcatgcgtatcattagctagttggtagggtaacggcttaccaaggcgacgatgattagggggcctgagagggtggtcccccacactgggactgagacacggcccagactcctacgggaggcagcagtagggaatattggtcaatgggcggaagcctgaaccagccatgccgcgtgatggatgacggccttagggttgtaaacatcttttctgctagaggacgactgtatagcaggaataaggatcggctaactccgtgccagcagccgcggtaatacggaggattcgagcgttatccggatttactgggtttaaagggtgcgcaggcgggctcttaagtcagcggtgaaatgtctgggcttaccctaggaattgccgttgatactgggagtcttggataagataaggacggcggaatgcgtagtgtagcggtgaaatgcttagatattacgtagaagaccaattgcgaaggcagctatctgggtctatcgacgctcaagcacgaaagcgtggggagcaaacaggattagataccctggtagtccacgccgtaaacgatgatcactcgctcttggcgtgtcaggggccaagcgaaagcgttaagtgatccacctggggagtacggccgcaaggctgaaactcaaaggaattgacgggggcccgcacaagcggaggaacatgtggtttaattcgatgatacgcgaggaaccttacctgggctagaacggtcgaggtgctgcatggttgtcgtcagctcgtgccgtgaggtgtcgggttaagtcccataacgagcgcaacccttatcgtcagttaccatcaattggggactctggcgagactgccggtgcaaaccggaggaaggtggggatgacgtcaaatcagcacggcccttacgtccagggcgacacacgtgttacaatgggtagcagagagttgccagccagcgatggtgagctaatctattctaccctcagttcggatggagtctgcaactcgactccagaagctggattcgctagtaatcgcgcatcagccatggcgcggtgaatacgttcccgggccttgtacacaccgcccgtcaagccatgaaagtcgtgggtgcctgaagttcgtagcgacctaaggcaaactcgatgattagggc

SEQ ID NO: 264 - DNA, 1267 bp, Bacteroidales sp.
  P7 oral clone MB3_P19
gcttaacacatgcaagtcgagggaccggcggatgggtgagtaacgcgtatgcaatctaccttttacccggggatagcccatggaaacgtggattaatacccgatgcataaagtcggtaagagatgagcatgcgttccattaggaagttggtaaggtaacggcttaccaatccgatgatggatgggggttctgagaggaaggtcccccacactggaattgagatacggtccagactcctacgggaggcagcagtgaggaatattggtcaatggtcgtaagactgaaccagccaagtcgcgtgaaggaaactgcctatgggttttcaacttcttttgtcagggaagatgccggtacctgacgaataaggatcggctaacgccgtgccagcagccgcggtaatacggaggatccgagcgttatccggatttattgggtttaaagggtgcttaggcggcatattaagttagtggtcaaatggtccggctcaaccggatttcgccattaaaactgatgtgctagagattaaacgaggtaggcggaataagttaagtagcggtgaaatgcatagatataacttagaactccgatagcgaaggcagcttaccaggctatctgacgctgaatcacgagagcgtgggtatcgaacaggattagataccctggtagtccacgccgtaaacgatgctcaccggctctatgcgtgtatggggctaatagaaataattaagtgagccacctggggagtacgtcggcaacgatgaaactcaaaggaattgacgggggcccgcacaagcggaggaacatgtggtttaattcgatgatacgcgaggaaccttacccgggtttaaatgtacaaggtgctgcatggttgtcgtcagctcgtgccgtgaggtgtcgggttaagtcccataacgagcgcaacccttatgattagttgctaacggccgagcactctattcacactgccaccgtaaggtggaggaaggaggggatgatgtcaaatcagcacggcccttatatccggggctacacacgtgttacaatggtcggcagagggttgcatttacgagagtaacagctaatcccttcggtcacagttcggatggagtctgcgactcgactccagaagttggattcgctagtaatcgcacatcagccatggtgcggtgaatacgttcccgggccttgtacacaccgcccgtcaagccatgggagctgagggtgcctgaagttcgtagcgacctagggcaaacttggtaactggggc

SEQ ID NO: 265 - DNA, 1292 bp, Bacteroidales sp.
  P8 oral clone MB4_G15
gatgaacgctagcggcaggcctaacacatgcaagtcgagggaccggcgaacgggtgcgtaacgcgtgaacaacttgccggacacagggggataatcgtcggaaacgtcgtctaatatcccataacgaaaggcggtgtctgataggttcgcgtgacattagctagtcggtggggcaacggcccaccgaggcgacgatgtctaggggttctgagaggaaggccccccacactgggactgagacacggcccagactcctacgggaggcagcagtgagggatattggacaatgggcggaagcctgatccagccatgccgcgtgaaggaataaggcctatgggtcgtaaacttcttttgacgcagagcatgagagtatgcgtcgaataagcatcggctaactccgtgccagcagccgcggtaatacggaggatgcgagcgttatccggatttattgggtttaaagggtgcgtaggctgttggataagtcagcggtgaaatcaccacgcttaacgtgttgtgtgccgttgaaactgtctggcttgaatgcgctcgtcgtgagaggaatgtgtggtgtagcggtgaaatgcatagatatcacacagaacaccgattgcgaaggcatctcacgagagcgattgacgctgatgcacgaaagcgcgggtatcgaacaggattagataccctggtagtccgcgctgtaaacgatgatgactaactgttggttgatcagtggtcaagcgaaagcgttaagtcatccacctggggagtacggccgcaaagctgaaactcaaaggaattgacgggggcccgcacaagcggaggaacatgtggtttaattcgatgatacgcgaggaaccttacccgggctcgaacggtcgaggtgctgcatggttgtcgtcagctcgtgccgtgaggtgtcggcttaagtgccataacgagcgcaacccttgccgtcagttgccatcagctggggactctgtcgggactgccaccgcaaggtggaggaagggggggatgacgtcaaatcagcacggcccctacgtccggggctacacacgtgttacaatggcgaccagaggggtgccacccggtgacggggcgccgatctccgtcgtctcagttcggatggagtctgcaacccgactccagaagctggattcgctagtaatcgcacatcagccatggtgcggtgaatacgttcccgggccttgtacacaccgcccgtcaagccatgagagccaggggcgcctgaagcgcgtaccggagcgttcaagggcgaaccaggtgattggggc

SEQ ID NO: 266 - DNA, 1495 bp, Bacteroides acidifaciens
tatcatggctcaagatgaacgctagctacaggcttaacacatgcaagtcgaggggcagcatgaaagtttgcttgcaaacttttgatggcgaccggcgcacgggtgagtaacacgtatccaacctgcctcatactcggggatagcctttcgaaagaaagattaatacccgatgtcatagtcctaccgcatgatgggattattaaagaatttcggtatgggatggggatgcgttccattagttagttggcggggtaacggcccaccaagacaacgatggataggggttctgagaggaaggtcccccacattggaactgagacacggtccaaactctacgggaggcagcagtgaggaatattggtcaatggacgagagtctgaaccagccaagtagcgtgaaggatgactgccctatgggttgtaaacttcttttatatgggaataaaatgttccacgtgtgggattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactggactgcaactgacactgaggctcgaaagtgtgggtatcaaacaggattagataccctggtagtccacacagtaaacgatgaatactcgctgtttgcgatatacggcaagcggccaagcgaaagcattaagtattccacctggggagtacgccggcaacggtgaaactcaaaggaattgacgggggccgcacaagcggaggaacatgtggtttaattcgatgatacgcgaggaaccttacccgggcttaaattgcacctgaataatgtggaaacatgttagccgtaaggcaggtgtgaaggtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatgggaggtacagaaggccgctacctggcgacaggatgccaatccccaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaagatcgtcctagggtaaaactggtaattggggctaagtcgtaacaaggtagccgtaccggaaggtgcg

SEQ ID NO: 267 - DNA, 1456 bp, Bacteroides barnesiae
tcaggatgaacgctagctacaggcttaacacatgcaagtcgaggggcagcgggaagtcagcttgctgactttgccggcgaccggcgcacgggtgagtaacacgtatccaaccttccgcatactctggaatagcctttcgaaagaaagattaatgcccgatggtatcaagagattgcatgatatctcgaataaagattcatcggtatgcgatggggatgcgttccattaggcagttggcggggtaacggcccaccaaaccgacgatggataggggttctgagaggaaggtcccccacattggaactgagacacggtccaaactcctacgggaggcagcagtgaggaatattggtcaatgggcgagagcctgaaccagccaagtagcgtgaaggatgactgccctacgggttgtaaacttcttttataagggaataaagttctctacgtgtagagttttgtatgtaccttatgaataagcatcggctaactccgtgccagcagccgcggtaatacggaggatgcgagcgttatccggatttattgggtttaaagggagcgtagacggcggtttaagtcagctgtgaaatggtgcggctcaaccgtagcactgcagttgaaactggacggcttgagtgcagttgaggcaggcggaattcgtggtgtagcggtgaaatgcttagatatcacgaagaaccccgattgcgaaggcagcctgctaagctgcaactgacgttgaggctcgaaagtgtgggtatcaaacaggattagataccctggtagtccacacggtaaacgatggatactcgctgttggcgatatactgtcagcggccaagtgaaaacgttaagtatcccacctggggagtacgccggcaacggtgaaactcaaaggaattgacgggggcccgcacaagcggaggaacatgtggtttaattcgatgatacgcgaggaaccttacccgggcttgaattgcagacgaatcatccggagacggatgagccgcaaggcgtctgtgaaggtgctgcatggttgtcgtcagctcgtgccgtgaggtgtcggcttaagtgccataacgagcgcaaccctttccgccggttactaacaggtgatgctgaggactccgacggtactgccatcgtaagatgtgaggaaggtggggatgacgtcaaatcagcacggcccttacgtccggggctacacacgtgttacaatggggggtacagaaggcagcgaccgggcgaccggaagcgaatccctaaagcccctctcagttcggactggagtctgcaacccgactccacgaagctggattcgctagtaatcgcgcatcagccacggcgcggtgaatacgttcccgggccttgtacacaccgcccgtcaagccatgaaagccgggggtacctgaagtgcgtaaccgcgaggagcgccctagggtaaaaccggtaattggggctaa

SEQ ID NO: 268 - DNA, 1383 bp, Bacteroides caccae
tcgaggggcatcagtttggtttgcttgcaaaccaaagctggcgaccggcgcacgggtgagtaacacgtatccaacctgcctcatactcggggatagcctttcgaaagaaagattaatatccgatagcatatatttcccgcatgggttttatattaaagaaattcggtatgagatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgcgagtctgaaccagccaagtagcgtgaaggatgactgccctatgggttgtaaacttcttttatatgggaataaagtggtccacgtgtggatttttgtatgtaccatatgaataaggatcggctaactccgtgccagcagccgcggtaatacggaggatccgagcgttatccggatttattgggtttaaagggagcgtaggcggattgttaagtcagttgtgaaagtttgcggctcaaccgtaaaattgcagttgatactggcagtcttgagtgcagtagaggtgggcggaattcgtggtgtagcggtgaaatgcttagatatcacgaagaactccgattgcgaaggcagctcactggagtgtaactgacgctgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaattatggggaaacccatacgccgcaaggcatttgtgggtgaaatgcttagttgtcaccaagtcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatggggggtacagaaggccgctacctggtgacaggatgccaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 269 - DNA, 1377 bp, Bacteroides cellulosilyticus
  modified_base (24)..(24): a, c, t, g, unknown or other
tcgaggggcagcatgacctagcantaggttgatggcgaccggcgcacgggtgagtaacacgtatccaacctaccggttattccgggatagcctttcgaaagaaagattaataccggatagtataacgagaaggcatctttttgttattaaagaatttcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaattcttttatatgggaataaagtgagccacgtgtggctttttgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgtttgcgatatacagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatctgaataatttggaaacagattagccgtaaggcagatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacacagcgatgtgatgctaatcccaaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtccgtaaccgcaag

SEQ ID NO: 270 - DNA, 1531 bp, Bacteroides clarus
ttacaatgaagagtttgatcctggctcaggatgaacgctagctacaggcttaacacatgcaagtcgaggggcagcggggttgaagcttgcttcaaccgccggcgaccggcgcacgggtgagtaacacgtatccaacctgccgataactccgggatagcctttcgaaagaaagattaataccggatggcatagttttcccgcatggaataactattaaagaatttcggttatcgatggggatgcgttccattaggcagttggcggggtaacggcccaccaaaccgacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagttagccacgtgtggttttttgcatgtaccgtatgaataaggatcggctaactccgtgccagcagccgcggtaatacggaggatccgagcgttatccggatttattgggtttaaagggagcgtaggcggggtattaagtcagttgtgaaagtttgcggctcaaccgtaaaattgcagttgatactggtatccttgagtgcagcagaggtgggcggaattcgtggtgtagcggtgaaatgcttagatatcacgaagaactccgattgcgaaggcagctcactggagtgtaactgacgctgatgctcgaaagtgtgggtatcaaacaggattagataccctggtagtccacacagtaaacgatgaatactcgctgttggcgatacaatgtcagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttgaattgcaactgacggaattggaaacagttctttcttcggacagttgtgaaggtgctgcatggttgtcgtcagctcgtgccgtgaggtgtcggcttaagtgccataacgagcgcaacccttatcgatagttaccatcaggtcatgctggggactctatcgagactgccgtcgtaagatgtgaggaaggtggggatgacgtcaaatcagcacggcccttacgtccggggctacacacgtgttacaatggggggtacagaaggcagctacacggcgacgtgatgctaatccccaaaacctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtacgtaaccgcaaggagcgtcctagggtaaaactggtgattggggctaagtcgtaacaaggtagccgtaccggaaggtgcggctggaacacctcctttct

SEQ ID NO: 271 - DNA, 1489 bp, Bacteroides coagulans
ggctcaggacgaacgctggcggcgtgcttaacacatgcaagtcgaacgatgaagaaaagaatcgaagcttcggcagaaattcatttcggattagtggcagacgggtgagtaacgcgtgagcaacctacctcttacaaagggatagcctcgggaaaccgggattaataccatataacattgcgacgaagcatttcgatgcaatcaaagctacggcggtaagagatgggctcgcgtcccattaaccagatggtgaggtaacggctcaccatagtaacgatgggtaaccggcctgagagggtgaacggtcacactggaactgagacacggtccagactcctacgggaggcagcagtggggaatattgcacaatggagggaactctgatgcagcgacgccgcgtgagtgatgaaggaattcgtttcgtaaaactctgttctatgggaagaaaaggactgtaccataggagaaagctccggctaaatacgtgccagcagccgcggtaatacgtatggagcgagcgttgtccggaattattgggcgtaaagggtgcgcaggcggctttacaagttggatgtgaaatattgtggctcaaccacaaacgtgcatccaaaactgcaaagcttgagttaaggagaggtaagtggaattcctggtgtagcggtggaatgcgtagatatcaggaggaataccggtggcgaaggcgacttactggacttaaactgacgctcaggcacgaaagcgtggggagcaaacaggattagataccctggtagtccacgccgtaaacgatgagtgctaggtgttgggggtcaaacctcggtgccgcaagcaaacgcaataagcactccgcctggggagtacgtgcacaagcatgaaactcaaaggaattgacggggacccgcacaagcagcggagcatgtggtttaattcgtggctacgcgaagaaccttaccagggcttgacatatatatgaggggacatagagatatgaaaccagtaagagcttgctcttaacatatatacaggtggtgcatggttgtcgtcagctcgtgtcgtgagatgttgggttaagtcccgcaacgagcgcaacccttgcaattagttactaacagatcatgctgaggactctaattggactgccgatgataaatcggaggaaggtggggatgacgtcaaatcatcatgccctttatgtcctgggctacacacgtgctacaatggtcggaacaaagaggagcgaaatggtgacatcaagcaaatctcaaaaaaccgatcccagttcggattgtactctgcaactcgagtacatgaagtcggagttgctagtaatcgcggatcagaatgccgcggtgaatgcgttcccgggtcttgtacacaccgcccgtcacaccatggaagttggcaatacccgaagccgatggcctaaccgcaaggaaggagtcgtcgaaggtagggtcaatgactggggtgaagtcgtaacaaggtaacc

SEQ ID NO: 272 - DNA, 1532 bp, Bacteroides coprocola
ttacaatgaagagtttgatcctggctcaggatgaacgctagctacaggcttaacacatgcaagtcgaggggcagcatgaacttagcttgctaagtttgatggcgaccggcgcacgggtgagtaacacgtatccaaccttccgtttactcagggatagcctttcgaaagaaagattaatacctgatagtatggtgagattgcatgatggcaccattaaagatttattggtaaacgatggggatgcgttccattaggtagtaggcggggtaacggcccacctagcctgcgatggataggggttctgagaggaaggtcccccacattggaactgagacacggtccaaactcctacgggaggcagcagtgaggaatattggtcaatgggcgagagcctgaaccagccaagtagcgtgaaggatgaaggtcctacggattgtaaacttcttttatacgggaataaagtttcctacgtgtaggattttgtatgtaccgtatgaataagcatcggctaactccgtgccagcagccgcggtaatacggaggatgcgagcgttatccggatttattgggtttaaagggagcgcagacgggagattaagtcagttgtgaaagtttgcggctcaaccgtaaaattgcagttgatactggtttccttgagtgcagttgaggcaggcggaattcgtggtgtagcggtgaaatgcttagatatcacgaagaaccccgattgcgaaggcagcttgctaaactgtaactgacgttcatgctcgaaagtgtgggtatcaaacaggattagataccctggtagtccacacggtaaacgatggatactcgctgttggcgatatactgtcagcggccaagcgaaagcattaagtatcccacctggggagtacgccggcaacggtgaaactcaaaggaattgacgggggcccgcacaagcggaggaacatgtggtttaattcgatgatacgcgaggaaccttacccgggcttaaattgcagacgaattacgaggaaacttgtaagccgcaaggcgtctgtgaaggtgctgcatggttgtcgtcagctcgtgccgtgaggtgtcggcttaagtgccataacgagcgcaaccctcgtggtcagttactaacaggttaagctgagggctctggccagactgccatcgtaagatgtgaggaaggtggggatgacgtcaaatcagcacggcccttacgtccggggctacacacgtgttacaatgggaggtacagaaggccgctacccggcaacgggatgccaatccccaaaacctctctcagttcggactggagtctgcaacccgactccacgaagctggattcgctagtaatcgcgcatcagccacggcgcggtgaatacgttcccgggccttgtacacaccgcccgtcaagccatgaaagccgggggtacctgaagtgcgtaaccgcaaggagcgccctagggtaaaaccggtaattggggctaagtcgtaacaaggtagccgtaccggaaggtgcggctggaacacctcctttct

SEQ ID NO: 273 - DNA, 1535 bp, Bacteroides coprophilus
ttacaatgaagagtttgatcctggctcaggatgaacgctagctacaggcttaacacatgcaagtcgaggggcagcgggattgaagcttgcttcaattgccggcgaccggcgcacgggtgagtaacgcgtatccaaccttccgcttactcggggatagcctttcgaaagaaagattaatacccgatggtatcttaagcacgcatgagattaagattaaagatttatcggtaagcgatggggatgcgttccattaggcagttggcggggtaacggcccaccaaacctacgatggataggggttctgagaggaaggtcccccacattggaactgagacacggtccaaactcctacgggaggcagcagtgaggaatattggtcaatgggcgagagcctgaaccagccaagtagcgtgaaggatgacggccctacgggttgtaaacttcttttgtgcgggaataaaggaacctacgtgtaggtttttgcatgtaccgtaacgaataagcatcggctaactccgtgccagcagccgcggtaatacggaggatgcgagcgttatccggatttattgggtttaaagggagcgtagacgggtttttaagtcagctgtgaaagtttggggctcaaccttaaaattgcagttgaaactggagaccttgagtacggttgaggcaggcggaattcgtggtgtagcggtgaaatgcttagatatcacgaagaaccccgattgcgaaggcagcctgctaagccgccactgacgttgaggctcgaaagtgcgggtatcaaacaggattagataccctggtagtccgcacggtaaacgatggatactcgctgttggcgatagacagtcagcggccaagcgaaagcgttaagtatcccacctggggagtacgccggcaacggtgaaactcaaaggaattgacgggggcccgcacaagcggaggaacatgtggtttaattcgatgatacgcgaggaaccttacccgggcttgaactgcagtggaattatccggaaacggataagcgagcaatcgccgctgtggaggtgctgcatggttgtcgtcagctcgtgccgtgaggtgtcggcttaagtgccataacgagcgcaacccttgctgccagttactaacaggtcatgctgaggactctggcaggactgccatcgtaagatgcgaggaaggtggggatgacgtcaaatcagcacggcccttacgtccggggctacacacgtgttacaatggggagtacagagggcagctaccgggcgaccggatgcgaatcccgaaagctcctctcagttcggactggagtctgcaacccgactccacgaagctggattcgctagtaatcgcgcatcagccacggcgcggtgaatacgttcccgggccttgtacacaccgcccgtcaagccatgaaagccgggggtacctgaagtacgtaaccgcgaggatcgtcctagggtaaaaccggtaattggggctaagtcgtaacaaggtagccgtaccggaaggtgcggctggaacacctcctttct

SEQ ID NO: 274 - DNA, 1384 bp, Bacteroides dorei
gaggggcagcatggtcttagcttgctaaggctgatggcgaccggcgcacgggtgagtaacacgtatccaacctgccgtctactcttggccagccttctgaaaggaagattaatccaggatggcatcatgagttcacatgtccgcatgattaaaggtattttccggtagacgatggggatgcgttccattagatagtaggcggggtaacggcccacctagtcaacgatggataggggttctgagaggaaggtcccccacattggaactgagacacggtccaaactcctacgggaggcagcagtgaggaatattggtcaatgggcgatggcctgaaccagccaagtagcgtgaaggatgactgccctatgggttgtaaacttcttttataaaggaataaagtcgggtatgcatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatgtcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacggcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcactcgaatgatccggaaacggttcagctagcaatagcgagtgtgaaggtgctgcatggttgtcgtcagctcgtgccgtgaggtgtcggcttaagtgccataacgagcgcaacccttgttgtcagttactaacaggtgatgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatccctaaaacccctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcga

SEQ ID NO: 275 - DNA, 1382 bp, Bacteroides eggerthii
tcgaggggcagcatgattgaagctgtgcttcaattgatggcgaccggcgcacgggtgagtaacacgtatccaacctgccgataactcggggatagcctttcgaaagaaagattaatacccgatagtatagtatttccgcatggtttcactattaaagaatttcggttatcgatggggatgcgttccattagatagttggcggggtaacggcccaccaagtcaacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtggagtatgcatactcctttgtatgtaccgtatgaataaggatcggctaactccgtgccagcagccgcggtaatacggaggatccgagcgttatccggatttattgggtttaaagggagcgtaggcgggtgcttaagtcagttgtgaaagtttgcggctcaaccgtaaaattgcagttgatactgggcgccttgagtgcagcataggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgttggcgatacacagtcagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaagttgtgaaggtttgcggctcaaccgtaacatcgcactggatactgggcggcttgagtgtagtatacgtaggcggaagccgtgaggtgtcggcttaagtgccataacgagcgcaacccttatctatagttactatcaggtcatgctgaggactctatggagactgccgtcgtaagatgtgaggaaggtggggatgacgtcaaatcagcacggcccttacgtccggggctacacacgtgttacaatggggggtacagaaggcagctacctggcgacaggatgctaatccctaaaacctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtacgtaaccgcaa

SEQ ID NO: 276 - DNA, 1383 bp, Bacteroides faecis
tcgaggggcagcattccagtttgcttgcaaactggagatggcgaccggcgcacgggtgagtaacacgtatccaacctgccgataactcggggatagcctttcgaaagaaagattaatacccgatggcataatagaaccgcatggtttgattattaaagaatttcggttatcgatggggatgcgttccattaggcagttggtggggtaacggcccaccaaaccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtgatccacgtgtggatttttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatatattggaaacagtatagtcgtaagacgaatgtgactgtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatggggggtacagaaggccgctacctggtgacaggatgctaatcccaaaagcctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 277 - DNA, 1306 bp, Bacteroides finegoldii
  modified_base (1029)..(1029): a, c, t, g, unknown or other
  modified_base (1125)..(1125): a, c, t, g, unknown or other
  modified_base (1261)..(1261): a, c, t, g, unknown or other
  modified_base (1281)..(1281): a, c, t, g, unknown or other
aagatggcgaccggcgcacgggtgagtaacacgtgtccaacctgccgataactcagggatagcctttcgaaagaaagattaatacctgatggcataggattgtcgcatgataatcctattaaagaatttcggttatcgatggggatgcgttccattaggcagttggtgaggtaacggctcaccaaaccttcgatggataggggttctgagaggaaggtcccccacattggaactgagacacggtccaaactcctacgggaggcagcagtgaggaatattggtcaatggacgggagtctgaaccagccaagtagcgtgaaggatgactgccctatgggttgtaaacttcttttatacgggaataaagtgatccacgggtttttgtatgtaccgtatgaataaggatcggctaactccgtgccagcagccgcggtaatacggaggatccgagcgttatccggatttttgggtttaaagggagcgtagtggattgttaagtcagttgtgaaagtttgcggctcaaccgtaaaattgcagttgatactggcagtcttgatacagtaaggtgggcggaattcgtggtgtacggtgaaatgcttaatatcacgaaaactccgattgcgaaggcagctcactggactgcaactgacactgatgctcgaaagtgtgggtatcaaacaggattaataccctggtagtccacacagtaaacgatgaatactcgctgtttgcgatatacggtaagcggccaagcgaaagcgttaagtattccacctggggagtacgccggcaacggtgaaactcagaggaattgacgggggcccgcacaagcggaggaacatgtggtttaattgtatgatactcgaggaaccttacccgggcttaaattacctttgaattatctggaaacaggttaaccgtaaggcacagtgaaggttgctgcatggttgtcgtcagctcgtgccgtgaggtgtcggcttaagttccataacgagcgcaacccttatcttcagttactaacaggtcatgntgaggactctggagagactgccgtcgtaagatgtgaggaaggtggggatgacgtcaaatcagcacggcccttacgtccggggctacacacgtgttncaatggggggtacagaaggcagctacctggtgacaggatgctaatcccaaaaacctctctcagttcggatcgaagtctgcaacccgacttcgtgaagctggattcgttagtaatcgcgcatcacccatggcgcggngaatacgttcccgggccttnccaccccgcccctcaagccatgaaa

SEQ ID NO: 278 - DNA, 1529 bp, Bacteroides fluxus
ttacaatgaagagtttgatcctggctcaggatgaacgctagctacaggcttaacacatgcaagtcgaggggcagcatttttatagcaatataaaagatggcgaccggcgcacgggtgagtaacacgtatccaacctgccgataactcggggataacccttcgaaagaaggcctaatacccgatggcatatcccttccgcctggttgggatattaaagaacttcggttatcgatggggatgcgttccattagcttgttggcggggtaacggcccaccaaggcttcgatggataggggttctgagaggaaggtcccccacattggaactgagacacggtccaaactcctacgggaggcagcagtgaggaatattggtcaatggacgagagtctgaaccagccaagtagcgtgaaggatgaaggtcctatggattgtaaacttcttttatacgggaataaagtgcagtatgcatactgttttgtatgtaccgtatgaataaggatcggctaactccgtgccagcagccgcggtaatacggaggatccgagcgttatccggatttattgggtttaaagggagcgtaggcggatgcttaagtcagttgtgaaagtttgcggctcaaccgtaaaattgcagttgatactgggcgtcttgagtacagtagaggcaggcggaattcgtggtgtagcggtgaaatgcttagatatcacgaagaactccgattgcgaaggcagcctgctggactgtcactgacgctgatgctcgaaagtgtgggtatcaaacaggattagataccctggtagtccacacagtaaacgatgaatactcgctgttggcgatacacagtcagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcatatgagttatccggagacggataagccgcaaggcatatgtgaaggtgctgcatggttgtcgtcagctcgtgccgtgaggtgtcggcttaagtgccataacgagcgcaacccttatcgatagttaccatcaggtcatgctggggactctgtcgagactgccgtcgtaagatgcgaggaaggtggggatgacgtcaaatcagcacggcccttacgtccggggccacacacgtgttacaatggggggtacagaaggccgctacacagcgatgtgatgccaatccccaaaacccctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcgaggagcgccctagggtaaaactggtgattggggctaagtcgtaacaaggtagccgtaccggaaggtgcggctggaacacctcctttct

SEQ ID NO: 279 - DNA, 1383 bp, Bacteroides fragilis
  modified_base (23)..(23): a, c, t, g, unknown or other
tcgaggggcatcaggaagaaagnttgctttctttgctggcgaccggcgcacgggtgagtaacacgtatccaacctgccctttactcggggatagcctttcgaaagaaagattaatacccgatggcataatgattccgcatggtttcattattaaaggattccggtaaaggatggggatgcgttccattaggttgttggtgaggtaacggctcaccaagccttcgatggataggggttctgagaggaaggtcccccacattggaactgagacacggtccaaactcctacgggaggcagcagtgaggaatattggtcaatgggcgctagcctgaaccagccaagtagcgtgaaggatgaaggctctatgggtcgtaaacttcttttatataagaataaagtgcagtatgtatactgttttgtatgtattatatgaataaggatcggctaactccgtgccagcagccgcggtaatacggaggatccgagcgttatccggatttattgggtttaaagggagcgtaggtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcagtggtatgatgtgggaacatgtcagtgagcaatcaccgctgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctagcgggtgaccgtatgctaatcccaaaagcctctctcagttcggatcgaagtctgcaacccgacttcgtgaagctggattcgctagtaatcgcgcatcagccacggcgcggtgaatacgttcccgggccttgtacacaccgcccgtcaagccatgggagccgggggtacctgaagtacgtaaccgcaa

SEQ ID NO: 280 - DNA, 1431 bp, Bacteroides galacturonicus
  modified_base (786)..(786): a, c, t, g, unknown or other
  modified_base (1402)..(1402): a, c, t, g, unknown or other
tgcaagtcgaacgaagcatttaagacagattacttcggtttgaagtcttttatgactgagtggcggacgggtgagtaacgcgtgggtaacctgcctcatacagggggatagcagctggaaacggctggtaataccgcataagcgcacagtaccacatggtacagtgtgaaaaactccggtggtatgagatggacccgcgtctgattagcttgttggcggggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggcacataagtgcnccggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggtcagtaatgtgaccttttcttcggaacaagagtgacaggtggtgcatggttgtcgtcagctcgtgtcgtgagatgttgggttaagtcccgcaacgagcgcaacccttatccttagtagccagcagtccggctgggcactctagggagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagtcggtgacctaacgtaagaaggagccgccnaaggcaggtctgataactggggtgaagtc

SEQ ID NO: 281 - DNA, 1513 bp, Bacteroides helcogenes
agagtttgatcctggctcaggatgaacgctagctacaggcttaacacatgcaagtcgaggggcagcattgtcatagcaatatgacagatggcgaccggcgcacgggtgagtaacacgtatccaacctgccttccactcgggaatagcctttcgaaagaaagattaatgcccgatggcactgaaagaggtcatcctttttcagttaaagaatttcggtggaagatggggatgcgttccattagcttgttggcggggtaacggcccaccaaggcatcgatggataggggttctgagaggaaggtcccccacattggaactgagacacggtccaaactcctacgggaggcagcagtgaggaatattggtcaatgggcgggagcctgaaccagccaagtagcgtgaaggatgactgccctatgggttgtaaacttcttttataagggaataaaacgggccacgtgtggccttttgcatgtaccttatgaataaggatcggctaactccgtgccagcagccgcggtaatacggaggatccgagcgttatccggatttattgggtttaaagggagcgcagacggggtcttaagtcagttgtgaaagtttgcggctcaaccgtaaaattgcagttgatactggggctcttgagtgcagtataggcaggcggaattcgtggtgtagcggtgaaatgcttagatatcacgaagaactccgattgcgaaggcagcctgctggactgtaactgacgttcatgctcgaaagtgcgggtatcaaacaggattagataccctggtagtccgcacagtaaacgatgaatactcgctgttggcgatacacagtcagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgctaatgaatatggcggaaacgtcatagccgcaaggcattagtgaaggtgctgcatggttgtcgtcagctcgtgccgtgaggtgtcggcttaagtgccataacgagcgcaacccttatctatagttaccatcaggcaatgctggggactctatggagactgccgtcgtaagatgtgaggaaggttgggatgacgtcaaatcagcacggcccttacgtccggggctacacacgtgttacaatggggggtacagaaggcagctacacagcgatgtgatgctaatcccaaaaacctctctcagttcggactggagtctgcaacccgactccacgaagctggattcgctagtaatcgcgcatcagccacggcgcggtgaatacgttcccgggccttgtacacaccgcccgtcaagccatgaaagccgggggtacctgaagtgcgtaaccgcgaggagcgccctagggtaaaactggtgattggggctaagtcgtaacaaggtagccgtaccggaaggtgcggctggaacacct

SEQ ID NO: 282 - DNA, 1262 bp, Bacteroides heparinolyticus
tcaggatgaacgctagctacaggcttaacacatgcaagtcgagggaccggcgcacgggtgagtaacacgtatccaaccttccggtaactccggtatagcctttcgaaagaaagattaatcccggatagttaaagccggttaccgatggggatgcgttccattaggcagttggcggggtaacggcccaccaaacctacgatggataggggttctgagaggaaggtcccccacattggaactgagacacggtccaaactcctacgggaggcagcagtgaggaatattggtcaatgggcggaagcctgaaccagccaagtagcgtgaaggatgactgcctatgggttgtaaacttcttttataagggaatatgcatgtaccttatgaataaggatcggctaactccgtgccagcagccgcggtaatacggaggatccgagcgttatccggatttattgggtttaaagggagcgtaggcgggcgcttaagtcagctgtgaaagtttggggctcaaccttaaaattgcagttgatactgggtgccttgagtgcagtataggcaggcggaattcgtggtgtagcggtgaaatgcttagatatcacgaagaactcctattgcgaaggcagcttgctggagtgactgacgctgatgctcgaaagtgtgggtatcaaacaggattagataccctggtagtccacacagtaaacgatgaatactcgctgtttgcgtgcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccttatccacagttaccatcagctggggactctgtggagactgccgtcgtaagatggaggaagggggggatgacgtcaaatcagcacggcccttacgtccggggctacacacgtgttacaatggggggcagcaggcagctcggcggcgacgcccggccaatccctcccctctcagttcggatggagtctgcaacccgactccagaagctggattcgctagtaatcgcgcatcagccacggcgcggtgaatacgttcccgggccttgtacacaccgcccgtcaagccatgaaagccgggggtacctgaagtgcgtag

SEQ ID NO: 283 - DNA, 1301 bp, Bacteroides intestinalis
ttattccgggatagcctttcgaaagaaagattaatactggatagcataacgagaaggcatcttcttgttattaaagaatttcgataatcgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtgcagtatgtatactgttttgtatgtaccatacgaataaggatcggctaactccgtgccagcagccgcggtaatacggaggatccgagcgttatccggatttattgggtttaaagggagcgtaggcggattattaagtcagttgtgaaagtttgcggctcaaccgtaaaattgcagttgatactggtagtcttgagtgcagcagaggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgtttgcgatatacagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaactgacggatttggaaacagatcttccttcgggcagttgtgaattgcgaaggcggtttactgcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacacagcgatgtgatgctaatcccaaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtacgtaaccgcaa

SEQ ID NO: 284 - DNA, 1281 bp, Bacteroides massiliensis
catgcaagtcgagggaccggcgcacgggtgagtaacgcgtatccaacctgccttacactcttggacagccttctgaaagggagattaatacaagatgtttaaagccggtgtaagatggggatgcgttccattagatagtaggcggggtaacggcccacctagtcttcgatggataggggttctgagaggaaggtcccccacattggaactgagacacggtccaaactcctacgggaggcagcagtgaggaatattggtcaatggacgagagtctgaaccagccaagtagcgtgaaggatgaaggtttatggattgtaaacttcttttatacgggaatatgcatgtaccgtatgaataaggatcggctaactccgtgccagcagccgcggtaatacggaggatccgagcgttatccggatttattgggtttaaagggagcgtagatgggttgttaagtcagttgtgaaagtttgcggctcaaccgtaaaattgcaattgatactggcagtcttgagtacagttgaggtaggcggaattcgtggtgtagcggtgaaatgcttagatatcacgaagaactccgattgcgaaggcagcttactaacctgactgacattgatgctcgaaagtgtgggtatcaaacaggattagataccctggtagtccacacggtaaacgatgaatactcgctgtaggcgagtctgcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttgccgatagttactaacagctgaggactctgtcgggactgccatcgtaagatggaggaaggtggggatgacgtcaaatcagcacggcccttacgtccggggctacacacgtgttacaatggggggcagagggctgctaccacgcaagtggatgccaatcccacctctctcagttcggatgaagtctgcaacccgacttcagaagctggattcgctagtaatcgcgcatcagccacggcgcggtgaatacgttcccgggccttgtacacaccgcccgtcaagccatgggagccgggggtacctgaagtgcgtagcgccctagggtaaaactggtgactggggctaagtcgtaacaaggtaacc

SEQ ID NO: 285 - DNA, 1377 bp, Bacteroides nordii
  modified_base (12)..(13): a, c, t, g, unknown or other
tcgaggggcagnnggatgtagcaatacattgctggcgaccggcgcacgggtgagtaacacgtatccaacctgccttttactcggggataggctttcgaaagaaagattaatacccgatggtataatatttccgcatgggattattattaaagaatttcggtaaaagatggggatgcgttccattaggcagttggcggggtaacggcccaccaaaccttcgatggataggggttctgagaggaaggtcccccacattggaactgagacacggtccaaactcctacgggaggcagcagtgaggaatattggtcaatgggcgaaagcctgaaccagccaagtagcgtgaaggatgactgccctatgggttgtaaacttcttttataggggaataaaatgagccacgtgtggctttttgtatgtaccctatgaataaggatcggctaactccgtgccagcagccgcggtaatacggaggatccgagcgttatccggatttattgggtttaaagggagcgtaggtggacatgtaagtcagttgtgaaagtttgcggctcaaccgtaaaattgcagttgatactgtgtgtcttgagtacagtagaggtgggcggaattcgtggtgtagcggtgaaatgcttagatatcacgaagaactccgattgcgaaggcagctcactggactgttactgacactgaggctcgaaagtgtgggtatcaaacaggattagataccctggtagtccacacagtaaacgatgaatactcgctgtttgcgatatacagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatgttggggaaacccaacagccgtaaggcaaatgtgagcaggctgcatggtggtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaagcctctctcagttcggatcgaagtctgcaacccgacttcgtgaagctggattcgctagtaatcgcgcatcagccacggcgcggtgaatacgttcccgggccttgtacacaccgcccgtcaagccatgggagccgggggtacctgaagtacgtaaccgcaa

SEQ ID NO: 286 - DNA, 1485 bp, Bacteroides oleiciplenus
agagtttgatcctggctcaggatgaacgctagctacaggcttaacacatgcaagtcgaggggcatcaggatgtagcaatacattgctggcgaccggcgcacgggtgagtaacacgtatccaacctaccgattattccgggatagcctttcgaaagaaagattaatactggatagtataacgagaaggcatctttttgttattaaagaatttcgataatcgatggggatgcgttccattagtttgttggcggggtaacggcccaccaagacttcgatggataggggttctgagaggaaggtcccccacattggaactgagacacggtccaaactcctacgggaggcagcagtgaggaatattggtcaatgggcgagagcctgaaccagccaagtagcgtgaaggatgactgccctatgggttgtaaacttcttttatatgggaataaagtgcagtatgtatactgttttgtatgtaccatatgaataaggatcggctaactccgtgccagcagccgcggtaatacggaggatccgagcgttatccggatttattgggtttaaagggagcgtaggcggaagcttaagtcagttgtgaaagtttgcggctcaaccgtaaaattgcagttgatactgggtttcttgagtgcagtagaggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgtttgcgatatacagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaactgacgtaggtggaaacatctattccttcgggcagttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacacggcgacgtgatgctaatcccaaaaacctctctcagttcggattggagtctgcaactcgactccatgaagctggattcgctagtaatcgcgcatcagccacggcgcggtgaatacgttcccgggccttgtacacaccgcccgtcaagccatgaaagccgggggtacctgaagtccgtaaccgttaaggagcggcctagggtaaaactggtaattggggctaagtcgtaacaaggtaacc

SEQ ID NO: 287 - DNA, 1381 bp, Bacteroides ovatus
  modified_base (25)..(25): a, c, t, g, unknown or other
tcgaggggcagcattttagtttgcnttgcaaactaaagatggcgaccggcgcacgggtgagtaacacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtggaattttgtatgtaccatatgaataaggatcggctaactccgtgccagcagccgcggtaatacggagccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaattggctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 288 - DNA, 1531 bp, Bacteroides pectinophilus
atgagagtttgatcctggctcaggatgaacgctggcggcgtgcttaacacatgcaagtcgaacgaagcacttaatgagatttcttcggattgattattttgtgactgagtggcggacgggtgagtaacgcgtgggtaacctgccccagaccgggggataacagtcggaaacgactgctaataccgcataagcgcacagtgccgcatggcacagtgtgaaaaactccggtggtctgggatggacccgcgtccgattagttagttggcggggtaacggcccaccaagaccgcgatcggtagccgacctgagagggtgaccggccacattgggactgagacacggcccagactcctacgggaggcagcagtggggaatattgcacaatggaggaaactctgatgcagcgacgccgcgtgagcgaagaagtatttcggtatgtaaagctctgtcagcagggaagataatgacggtacctgaccaagaagccccggctaactacgtgccagcagccgcggtaatacgtagggggcaagcgttatccggatttactgggtgtaaagggagtgtaggtggctgtgcaagtcaggagtgaaagcccggggctcaaccccgggactgctcttgaaactgcgcagcttgagtgcaggaggggcaggcggaattcctagtgtagcggtgaaatgcgtagatattaggaggaacaccggtggcgaaggcggcctgctggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaggtcttgacatcctcctgaacggaaggtaatgcttccggtccttcgggacaggagagacaggtggtgcatggttgtcgtcagctcgtgtcgtgagatgttgggttaagtcccgcaacgagcgcaacccctatcctcagtagccagcagtccggctgggcactctgtggagactgccggggataacccggaggaaggtggggatgacgtcaaatcatcatgccccttatgacctgggctacacacgtgctacaatggcgctcaacaaagggaagcaatgccgcgaggccgagcaaatcccaaaaacagcgtcccagttcggactgtagtctgcaacccgactacacgaagctggaatcgctagtaatcgcgaatcagaatgtcgcggtgaatacgttcccgggtcttgtacacaccgcccgtcacaccatgggagtcggaaatgcccgaagtcagtgacccaaccgcaaggagggagctgccgaaggcaggtctggtaactggggtgaagtcgtaacaaggtagccgtatcggaaggtgcggctggatcacctcctttct

SEQ ID NO: 289 - DNA, 1326 bp, Bacteroides plebeius
gagtttgatcctggctcaggatgaacgctagctacaggcttaacacatgcaagtcgagggaccggcgcacgggtgagtaacgcgtatccaaccttccgtacactcagggatagcctttcgaaagaaagattaatacctgatggttaaagtcggtgtacgatggggatgcgttccattaggtagtaggcggggtaacggcccacctagcctacgatggataggggttctgagaggaaggtcccccacattggaactgagacacggtccaaactcctacgggaggcagcagtgaggaatattggtcaatggacgagagtctgaaccagccaagtagcgtgaaggatgaaggtctacggattgtaaacttcttttataagggaatatgtatgtaccttatgaataagcatcggctaactccgtgccagcagccgcggtaatacggaggatgcgagcgttatccggatttattgggtttaaagggagcgcagacgggtcgttaagtcagctgtgaaagtttggggctcaaccttaaaattgcagttgatactggcgtccttgagtgcggttgaggtgtgcggaattcgtggtgtagcggtgaaatgcttagatatcacgaagaactccgattgcgaaggcagcacactaagccgactgacgttcatgctcgaaagtgtgggtatcaaacaggattagataccctggtagtccacacggtaaacgatggatactcgctgttggcgagtcagcggcttagcgaaagcgttaagtatcccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaaccctcgccgccagttactaacagctgaggactctggcgggactgccatcgtaagatggaggaaggtggggatgacgtcaaatcagcacggcccttacgtccggggctacacacgtgttacaatgggcggcagaaggcagctacctggcgacaggatgccaatcccgccgctctcagttcggatggagtctgcaacccgactccagaagctggattcgctagtaatcgcgcatcagccacggcgcggtgaatacgttcccgggccttgtacacaccgcccgtcaagccatgaaagccgggggtacctgaagtgcgtagcgccctagggtaaaaccggtaattggggctaagtcgtaacaaggtaacc

SEQ ID NO: 290 - DNA, 1458 bp, Bacteroides pyogenes
ttagagtttgatcctggctcaggatgaacgctagctacaggcttaacacatgcaagtcgaggggcagcatgaatattggcttgccaatatttgatggcgaccggcgcacgggtgagtaacacgtatccaaccttccggttactcggggataggctttcgaaagaaagattaatacccgatgttgtgtatctttctcctgattgatacgccaaaggattccggtaaccgatggggatgcgttccattaggcagttggcggggtaacggcccaccaaaccttcgatggataggggttctgagaggaaggtcccccacattggaactgagacacggtccaaactcctacgggaggcagcagtgaggaatattggtcaatggacggaagtctgaaccagccaagtagcgtgaaggatgactgccctctgggttgtaaacttcttttatacgggaataacatgaggtacgggtaccttattgcatgtaccgttatgaataagcatcggctaactccgtgccagcagccgcggtaatacggaggatgcgagcgttatccggatttattgggtttaaagggagcgtaggtgggatattaagtcagctgtgaaagtttggggctcaaccttaaaattgcagttgatactggttttcttgagtacggtataggtgggcggaattcgtggtgtagcggtgaaatgcttagatatcacgaagaactcctattgcgaaggcagctcactggaccggcactgacactgatgctcgaaagtgcgggtatcaaacaggattagataccctggtagtccgcacagtaaacgatgaatactcgctgtttgcgatacacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcgctggcttttaccggaaacggtattttcttcggaccagcgtgaaggtgctgcatggttgtcgtcagctcgtgccgtgaggtgtcggcttaagtgccataacgagcgcaacccttatctttagttgccatcaggttttgctggggactctaaagagactgccgtcgtaagatgcgaggaaggtggggatgacgtcaaatcagcacggcccttacgtccggggctacacacgtgttacaatggggagcacagcaggttgctacacggcgacgtgatgccaatccgtaaaactcctctcagttcggatcgaagtctgcaacccgacttcgtgaagctggattcgctagtaatcgcgcatcagccacggcgcggtgaatacgttcccgggccttgtacacaccgcccgtcaagccatgaaagccgggggtacctgaagtacgtaaccgcaaggatcgtccttagtaaac

SEQ ID NO: 291 - DNA, 1521 bp, Bacteroides salanitronis
agagtttgatcctggctcaggatgaacgctagctacaggcttaacacatgcaagtcgcggggcagcgggagcctagcttgctaggcttgccggcgaccggcgcacgggtgagtaacgcgtatccgaccttccgcacactccgggccagccttccgaaaggaagattaatcccggatggtatggcgtggctgcatggcagcgccattaaaggagcgatccggtgtgcgatgggggtgcgttccattagcttgttggcggggtaacggcccaccaaggcgacgatggataggggttctgagaggaaggccccccacattgggactgagacacggcccaaaactcctacgggaggcagcagtgaggaatattggtcaatgggcgagagcctgaaccagccaagtagcgtggaggatgaccgccctacgggttgtaaactccttttataagggaataaaacctcccacgtgtgggagcttgtatgtaccttatgaataagcatcggctaactccgtgccagcagccgcggtaatacggaggatgcgagcgttatccggatttattgggtttaaagggagcgtagacgggatgtcaagtcagctgtgaaagtttgcggctcaaccgtaaaattgcagttgaaactggctttcttgagtgcgttcgaggcaggcggaattcgtggtgtagcggtgaaatgcatagatatcacgaagaaccccgattgcgaaggcagcctgctaggccgcaactgacgttgatgctcgaaagtgcgggtatcaaacaggattagataccctggtagtccgcacggtaaacgatgggcactcgctgccggcgatatactgccggcggcttagcgaaagcgttaagtgccccacctggggagtacgccggcaacggtgaaactcaaaggaattgacgggggcccgcacaagcggaggaacatgtggtttaattcgatgatacgcgaggaaccttacccgggcttgaactgcggatgcattgcgcggaaacgcgcaagtgggcaaccacatccgtggaggtgctgcatggttgtcgtcagctcgtgccgtgaggtgtcggcttaagtgccataacgagcgcaaccccttccgccagttgccatcaggttatgctggggactctggcggtactgccatcgtaagatgcgaggaaggtggggatgacgtcaaatcagcacggcccttacgtccggggctacacacgtgttacaatggggggtacagagggccgccatccggcgacggagcgccaatccctaaagcccctcccagttcggactggagcctgcaacccggctccacgaagctggattcgctagtaatcgcgcatcagccacggcgcggtgaatacgttcccgggccttgtacacaccgcccgtcaagccatgaaagccgggggtgcctgaagtgcgtaaccgaaaggggcgccctagggtaaaaccggtgattggggctaagtcgtaacaaggtagccgtaccggaaggtgcggctggaacacct

SEQ ID NO: 292 - DNA, 970 bp, Bacteroides salyersiae
  modified_base (946)..(946): a, c, t, g, unknown or other
  modified_base (948)..(948): a, c, t, g, unknown or other
tcgaggggcatcagggtgtagcaatacgccgctggcgaccggcgcacgggtgagtaacacgtatccaacctgccctttactcggggatagcctttcgaaagaaagattaatacccgatggtataacatgacctcctggttttgttattaaagaatttcggtagaggatggggatgcgttccattaggcagttggcggggtaacggcccaccaaaccttcgatggataggggttctgagaggaaggtcccccacattggaactgagacacggtccaaactcctacgggaggcagcagtgaggaatattggtcaatgggcgagagcctgaaccagccaagtagcgtgaaggatgaccgccctatgggttgtaaacttcttttatatgggaataaagtctgccacgtgtggcattttgtatgtaccatatgaataaggatcggctaactccgtgccagcagccgcggtaatacggaggatccgagcgttatccggatttattgggtttaaagggagcgtaggtggacatgtaagtcagttgtgaaagtttgcggctcaaccgtaaaattgcagttgatactgcgtgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaatatgccggnancggcatagccgcaaggcatttg

SEQ ID NO: 293 - DNA, 1533 bp, Bacteroides sp.
  1_1_14
ttacaatgaagagtttgatcctggctcaggatgaacgctagctacaggcttaacacatgcaagtcgaggggcagcatttcagtttgcttgcaaactggagatggcgaccggcgcacgggtgagtaacacgtatccaacctgccgataactcggggatagcctttcgaaagaaagattaatacccgatggtataatcagaccgcatggtcttgttattaaagaatttcggttatcgatggggatgcgttccattaggcagttggtgaggtaacggctcaccaaaccttcgatggataggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatatattggaaacagtatagccgtaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaagcctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctttct

SEQ ID NO: 294 - DNA, 1345 bp, Bacteroides sp.
  1_1_30
tggcgaccggcgcacgggtgagtaacacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggcagctcacgagactgcaactgacgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 295 - DNA, 1381 bp, Bacteroides sp.
  1_1_6
  modified_base (1333)..(1333): a, c, t, g, unknown or other
  modified_base (1337)..(1338): a, c, t, g, unknown or other
aggggcagcatttcagtttgcttgcaaactggagatggcgaccggcgcacgggtgagtaacacgtatccaacctgccgataactcggggatagcctttcgaaagaaagattaatacccgatggtataatgaaaccgcatggtcttattattaaagaatttcggttatcgatggggatgcgttccattaggcagttggtgaggtaacggctcaccaaaccttcgatggataggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatatattggaaacagtatagccgtaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaagcctctctcagttcggatcgaagtctgcaacccgacttcgtgaagctggattcgctagtaatcgcgcatcagccatggcgcggtgaatacgttcccgggccttgtacacaccncggnntcaagccatgaaagccgggggtacctgaagtacgtaaccgcaa

SEQ ID NO: 296 - DNA, 1385 bp, Bacteroides sp.
  20_3
  modified_base (7)..(7): a, c, t, g, unknown or other
  modified_base (19)..(24): a, c, t, g, unknown or other
tcgaggnggcagcacaggnnnnnntaccgggtggcgaccggcgcacgggtgagtaacgcgtatgcaacttgcctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactgggaggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacacagtaagcggcacagcgaaagcgttaagtgatccacctggggagtacgccggcaacggtgaaactcaaaggaattgacgggggcccgcacaagcggacgaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggaagccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgcgaggatc

SEQ ID NO: 297 - DNA, 1382 bp, Bacteroides sp.
  2_1_22
tcgaggggcagcattttagtttgcttgcaaactgaagatggcgaccggcgcacgggtgagtaacacgtatccaacctgccgataactccgggatagcctttcgaaagaaagattaataccggatggcatactaatatcgcatgatatttttattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 298 - DNA, 945 bp, Bacteroides sp.
  2_1_56FAA
  modified_base (490)..(490): a, c, t, g, unknown or other
  modified_base (760)..(760): a, c, t, g, unknown or other
  modified_base (775)..(775): a, c, t, g, unknown or other
  modified_base (784)..(785): a, c, t, g, unknown or other
  modified_base (848)..(848): a, c, t, g, unknown or other
  modified_base (867)..(867): a, c, t, g, unknown or other
  modified_base (887)..(888): a, c, t, g, unknown or other
  modified_base (902)..(902): a, c, t, g, unknown or other
  modified_base (909)..(909): a, c, t, g, unknown or other
  modified_base (919)..(919): a, c, t, g, unknown or other
  modified_base (934)..(935): a, c, t, g, unknown or other
ttgctggcgaccggcgcacgggtgagtaacacgtatccaacctgccctttactcggggatagcctttcgaaagaaagattaatacccgatagcataatgattccgcatggtttcattattaaaggattccggtaaaggatggggatgcgttccattaggttgttggtgaggtaacggcccaccaagccttcgatggataggggttctgagaggaaggtcccccacattggaactgagacacggtccaaactcctacgggaggcagcagtgaggaatattggtcaatgggcgttagcctgaaccagccaagtagcgtgaaggatgaaggctctatgggtcgtaaacttcttttatataagaataaagtgcagtatgtatactgttttgtatgtattatatgaataaggatcggctaactccgtgccagcagccgcggtaatacggaggatccgagcgttatccggatttattgggtttaaagggagcgtangtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggncaagcgaaagcattnaagtattcnncctggggagtacgccggcaacggtgaaactcaaaggaattgacgggggcccgcacaagcggangaacatgtggtttaattcnatgatacgcgaggaaccttnncccgggcttaaatngcagtgnaatgatgtgnaaacatgtcagtganncatcaccact

SEQ ID NO: 299 - DNA, 1525 bp, Bacteroides sp.
  2_2_4
tacaatgaagagtttgatcctggctcaggatgaacgctagctacaggcttaacacatgcaagtcgaggggcagcatttcgctagcaatagtgaagatggcgaccggcgcacgggtgagtaacacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtgggattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactgggagtcttgagtacagtagaggtgggcggaattcgtggtgtagcggtgaaatgcttagatatcacgaagaactccgattgcgaaggcagctcactagactgtcactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaataatctggaaacaggttagccgcaaggcatttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctt

SEQ ID NO: 300 - DNA, 1362 bp, Bacteroides sp.
  315-5
taggcttaacacatgcaagtcgaggggcagcattatcttagcttgctaagatagatggcgaccggcgcacgggtgagtaacacgtatccaaccttccggttactcggggataggctttcgaaagaaagattaatacccgatgttgcgtatctttctcctgaaagatacgccaaaggattccggtaaccgatggggatgcgttccattaggcagttggcggggtaacggcccaccaaaccttcgatggataggggttctgagaggaaggtcccccacattggaactgagacacggtccaaactcctacgggaggcagcagtgaggaatattggtcaatggacggaagtctgaaccagccaagtagcgtgaaggatgactgccctctgggttgtaaacttcttttatacgggaataacatgaggtacgcgtaccttattgcatgtaccgttatgaataagcatcggctaactccgtgccagcagccgcggtaatacggaggatgcgagcgttatccggatttattgggtttaaagggagcgtaggtgggatattaagtcagctgtgaaagtttggggctcaaccttaaaattgcagttgatactggtttccttgagtacggtacaggtgggcggaattcgtggtgtagcggtgaaatgcttagatatcacgaagaactccgatcgcgaaggcagctcaccgggccggaactgacactgatgctcgaaagtgcgggtatcaaacaggattagataccctggtagtccgcacagtaaacgatgaatactcgctgtttgcgatacacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcgctggcttttaccggaaacggtattttcttcggaccagcgtgaaggtgctgcatggttgtcgtcagctcgtgccgtgaggtgtcggcttaagtgccataacgagcgcaacccttatctttagttactaacagttttgctgaggactctaaagagactgccgtcgtaagatgcgaggaaggtggggatgacgtcaaatcagcacggcccttacgtccggggctacacacgtgttacaatggggagcacagcaggttgctacacggcgacgtgatgccaatccgtaaaactcctctcagttcggatcgaagtctgcaacccgacttcgtgaagctggattcgctagtaatcgcgcatcagccacggcgcggtgaatacgttcccgggccttgtacacaccgcccgtcaag

SEQ ID NO: 301 - DNA, 1243 bp, Bacteroides sp.
  31SF15
taacacatgcacgtcgagggaccggcgcacgggtgagtaacacgtatccaacctaccggttattccgggatagcctttcgaaagaaagattaataccggatagttaaagtcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaacgagccaagtagcgtgaaggatgactgcctatgggttgtaaacttcttttatatgggaatatgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgactgacgctgatgctcgaaagtgtgggtatcaaacaggattagataccctggtagtccacacagtaaacgatgaatactcgctgtttgcgagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatctttagttacttacagctgaggactctagagagactgccgtcgtatgatggaggaaggtggggatgacgtcaaatcagcacggtcctatcgtccggggatacacacgtgttacaatggggggcagaaggcagctacacagcgatgtgatgctaatcccacctctagcagttcggatggagtctgcaacccgactccagaagctggattcgctagtaatcgcgcatcagcacggcgcggtgaatacgttcccgggccttgtacacaccgcccgtcaagccatgaaagccgggggtacctgaagtccgacggcctagg

SEQ ID NO: 302 - DNA, 1207 bp, Bacteroides sp.
  31SF18
acacatgcaagtcgagggaccggcgcacgggtgagtaacacgtatccaacctaccggttattctgggatagcctttcgaaagaaagattaataccggatagttaaagtcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatatgggaatatgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattactggtgtagcggtgaaatgcttagatatcacgaagaactccgattgcgaaggcagcttactggactgactgacgctgatgctcgaaagtgtgggtatcaaacaggattagataccctggtagtccacacagtaaacgatgaatactcgctgtttgcgagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatctttagttactaacagctgaggactctagagagactgccgtcgtaagatggaggaaggtggggatgacgtcaaatcagcacggcccttacgtccggggctacacacgtgttacaatggggggcagaaggcagctacacagcgatgtgatgctaatcccacctctctcagttcggatggagtctgcaacccgactccagaagctggattcgctagtaatcgcgcatcagccacggcgcggtgaatacgttcccgggccttgtacacaccgcccgtcaagccat

SEQ ID NO: 303 - DNA, 1254 bp, Bacteroides sp.
  35AE31
caggcttaacacatgcaagtcgagggaccggcgcacgggtgagtaacacgtatccaacctaccggttattctgggatagcctttcgaaagaaagattaataccggatagttaaagtcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatatgggaatatgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgactgacgctgatgctcgaaagtgtgggtatcaaacaggattagataccctggtagtccacacagtaaacgatgaatactcgctgtttgcgagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatctttagttactaacagctgaggactctagagagactgccgtcgtaagatggaggaaggtggggatgacgtcaaatcagcacggcccttacgtccggggctacacacgtgttacaatggggggcagaaggcagctacacagcgatgtgatgctaatcccacctctctcagttcggatggagtctgcaacccgactccagaagctggattcgctagtaatcgcgcatcagccaggcgcggtgaatacgttcccgggccttgtacacaccgcccgtcaagccatgaaagccgggggtacctgaagtccgtagcggcctagggta

SEQ ID NO: 304 - DNA, 1238 bp, Bacteroides sp.
  35AE37
gcttaacacatgcaagtcgagggaccggcgcacgggtgagtaacacgtatccaacctaccggttattccgggatagcctttcgaaagaaagattaataccggatagttaaagtcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgacccagccaagtagcgtgaaggatgactgcctatgggttgtaaacttcttttatatgggaatatgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgactgacgctgatgctcgaaagtgtgggtatcaaacaggattagataccctggtagtccacacagtaaacgatgaatactcgctgtttgcgagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgagccgtgaggtgtcggcttaagtgccataacgagcgcaacccttatctttagttactaacagctgaggactctagagagactgccgtcgtaagatggaggaaggtggggatgacgtcaaatcagcacggcccttacgtccggggctacacacgtgttacaatggggggcagaaggcagctacacagcgatgtgatgctaatcccacctctctcagttcggatggagtctgcaacccgactccagaagctggattcgctagtaatcgcgcatcagccacggcgcggtgaatacgttcccgggccttgtacacaccgcccgtcaagccatgaaagccgggggtacctgaagtccga

SEQ ID NO: 305 - DNA, 1229 bp, Bacteroides sp.
  35BE34
tcgagggaccggcgcacgggtgagtaacacgtatccaacctaccggttattctgggatagcctttcgaaagaaagattaataccggatagttaaagtcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatatgggaatatgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgactgacgctgatgctcgaaagtgtgggtatcaaacaggattagataccctggtagtccacacagtaaacgatgaatactcgctgtttgcgagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgcctaaacgagcgcaacccttatctttagttactaacagctgaggactctagagagactgccgtcgtaagatggaggaaggtggggatgacgtcaaatcagcacggcccttacgtccggggctacacacgtgttacaatggggggcagaaggcagctacacagcgatgtgatgctaatcccacctctctcagttcggatggagtctgcaacccgactccagaagctggattcgctagtaatcgtgcatcagccacggcgcggtgaatacgttcccgggccttgtacacaccgcccgtcaagccatgaaagccgggggtacctgaagtccgacggccta

SEQ ID NO: 306 - DNA, 1250 bp, Bacteroides sp.
  35BE35
acacatgcaagtcgagggaccggcgcacgggtgagtaacacgtatccaacctaccggttattccgggatagcctttcgaaagaaagattaataccggatagttaaagtcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatatgggaatatgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgactgacgctgatgctcgaaagtgtgggtatcaaacatgattagataccctggtagtccacacagtaaacgatgaatactcgctgtttgcgagcaagcggccaagcgaaagcattaagtattccacctggggagtacgccggcactggcgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatctttagttactaacagctgaggactctagagagactgccgtcgtaagatggaggaaggtggggatgacgtcaaatcagcacggcccttacgtccggggctacacacgtgttacaatggggggcagaaggcagctacatagcgatgtgatgctaatcccacctctctcagttcggatggagtctgcaacccgactccagaagctggattcgctagtaatcgcgcatcagccacggcgcggtgaatacgttcccgggccttgtacacaccgcccgtcaagccaataaagccgggggtacttgaagtccgagcggcctagggtaaaac

SEQ ID NO: 307 - DNA, 1351 bp, Bacteroides sp.
  3_1_19
  modified_base (301)..(301): a, c, t, g, unknown or other
taccgggtggcgaccggcgcacgggtgagtaacgcgtatgcaacttgcctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgtaagnctgaaccagccaagtcgcgtgagggatgaaggttctatggatcgtaaacctcttttataagggaataaagtgcgggacgtgtcccgttttgtatgtaccttatgaataaggcggctaactccgtgccagcagccgcggtaatacggaggccagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcatagatatcacgcagaaccccgattgcgaaggcagcctgccaagccattactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgaaa

SEQ ID NO: 308 - DNA, 1362 bp, Bacteroides sp.
  3_1_23
gtcgaggggcagcattttagtttgcttgcaaactgaagatggcgaccggcgcacgggtgagtaacacgtatccaacctgccgataactccggaatagcctttcgaaagaaagattaataccggatggtatacgaatatcgcatgatatttttattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggggcctgaacagccaagtacgtgaaggcttgggaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgtcactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaacagaatatattggaaacagtatagccgtgaagctgttgtgaatgtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcggctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 309 - DNA, 1532 bp, Bacteroides sp.
  3_1_33FAA
tacaatgaagagtttgatcctggctcaggatgaacgctagctacaggcttaacacatgcaagtcgaggggcagcatggtcttagcttgctaaggctgatggcgaccggcgcacgggtgagtaacacgtatccaacctgccgtctactcttggccagccttctgaaaggaagattaatccaggatgggatcatgagttcacatgtccgcatgattaaaggtattttccggtagacgatggggatgcgttccattagatagtaggcggggtaacggcccacctagtcaacgatggataggggttctgagaggaaggtcccccacattggaactgagacacggtccaaactcctacgggaggcagcagtgaggaatattggtcaatgggcgatggcctgaaccagccaagtagcgtgaaggatgactgccctatgggttgtaaacttcttttataaaggaataaagtcgggtatgcatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatgtcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacggcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcactcgaatgatccggaaacggttcagctagcaatagcgagtgtgaaggtgctgcatggttgtcgtcagctcgtgccgtgaggtgtcggcttaagtgccataacgagcgcaacccttgttgtcagttactaacaggtgatgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatccctaaaacccctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggatcgccctagggtaaaactggtgactggggctaagtcgtaacaaggtagccgtaccggaaggtgcggctggaacacctcctt

SEQ ID NO: 310 - DNA, 1045 bp, Bacteroides sp.
  3_1_40A
  modified_base (23)..(23): a, c, t, g, unknown or other
  modified_base (31)..(31): a, c, t, g, unknown or other
  modified_base (33)..(33): a, c, t, g, unknown or other
  modified_base (41)..(41): a, c, t, g, unknown or other
  modified_base (730)..(730): a, c, t, g, unknown or other
caagtagcgtgaaggatgactgncctatggntntaaacttntttataaaggaataaagtcgggtatgcatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacggcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggttntgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatcccaaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggag

SEQ ID NO: 311 - DNA, 1367 bp, Bacteroides sp.
  3_2_5
  modified_base (1270)..(1270): a, c, t, g, unknown or other
  modified_base (1355)..(1355): a, c, t, g, unknown or other
tcgaggggcagcacaggtagcaataccgggtggcgaccggcgcacgggtgagtaacgcgtatgcaacttgcctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgacacacggaccaaactcctacgggaggcagcagtgaggaatattggtcaatgggcgaaaggctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtagcggccttttaagtcacggtgaaagtctgtggctcaccataaattgccgttgaaactggggggcttgagtatgtttgaggcagcggaatgcgtggtgtacggtgaaatgcatagatatcacgcagaaccccgattggaaggcagcctgccaagccattactgacgtgatgcacgaaagcgtggggatcaaacaggattagataccctggtagtccacgcataaacgatgatcactatgtttgcgatacactgtaagcggcacagcgaaagcgttaagtgatccacctggggagtacgccggcaacggtgaaactcaaggaattgacgggggcccgcacaagcggagaacatgtggtttaattgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgngcatcagccatggcgcggtgaatacgttcccgggccttgtacacaccgcccgtcaagccatgggagccgggggtacctgaagtcngtaaccgaaagg

SEQ ID NO: 312 - DNA, 1386 bp, Bacteroides sp.
  4_1_36
tcgaggggcagcatgaacttagcttgctaagtttgatggcgaccggcgcacgggtgagtaacacgtatccaacctgccgatgactcggggatagcctttcgaaagaaagattaatacccgatggcatagttcttccgcatggtggaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacttgtcagccgcaaggcagttgtgaagatatcacgaggtactgcgattgcgaagccagctggctgggctttaagtgacactaatggcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggtgacgtgatgctaatcccgaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaaggagc

SEQ ID NO: 313 - DNA, 1515 bp, Bacteroides sp.
  4_3_47FAA
agagtttgatcctggctcaggatgaacgctagctacaggcttaacacatgcaagtcgaggggcagcatggtcttagcttgctaaggccgatggcgaccggcgcacgggtgagtaacacgtatccaacctgccgtctactcttggacagccttctgaaaggaagattaatacaagatggcatcatgagtccgcatgttcacatgattaaaggtattccggtagacgatggggatgcgttccattagatagtaggcggggtaacggcccacctagtcttcgatggataggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttataaaggaataaagtcgggtatgtatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacagcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggttcgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatcccaaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggagcgccctagggtaaaactggtgactggggctaagtcgtaacaaggtagccgtaccggaaggtgcggctggaacacct

SEQ ID NO: 314 - DNA, 1533 bp, Bacteroides sp.
  9_1_42FAA
tacaatgaagagtttgatcctggctcaggatgaacgctagctacaggcttaacacatgcaagtcgaggggcagcatggtcttagcttgctaaggctgatggcgaccggcgcacgggtgagtaacacgtatccaacctgccgtctactcttggccagccttctgaaaggaagattaatccaggatgggatcatgagttcacatgtccgcatgattaaaggtattttccggtagacgatggggatgcgttccattagatagtaggcggggtaacggcccacctagtcaacgatggataggggttctgagaggaaggtcccccacattggaactgagacacggtccaaactcctacgggaggcagcagtgaggaatattggtcaatgggcgatggcctgaaccagccaagtagcgtgaaggatgactgccctatgggttgtaaacttcttttataaaggaataaagtcgggtatgcatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatgtcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacggcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcactcgaatgatccggaaacggttcagctagcaatagcgagtgtgaaggtgctgcatggttgtcgtcagctcgtgccgtgaggtgtcggcttaagtgccataacgagcgcaacccttgttgtcagttactaacaggtgatgctgaggactctgacaagactgccatcgtaagatgtgaggaaggtggggatgacgtcaaatcagcacggcccttacgtccggggctacacacgtgttacaatgggggggtacagagggccgctaccacgcgagtggatgccaatccctaaaacccctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggatcgccctagggtaaaactggtgactggggctaagtcgtaacaaggtagccgtaccggaaggtgcggctggaacacctcctt

SEQ ID NO: 315 - DNA, 1489 bp, Bacteroides sp.
  AR20
gagtttgatcctggctcaggatgaacgctagctacaggcttaacacatgcaagtcgaggggcagcatgaacttagcttgctaagtttgatggcgaccggcgcacgggtgagtaacacgtatccaacctgccgatgactcggggatagcctttcgaaagaaagattaatacccgatggcatagttcttccgcatggtagaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgcgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcctgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacatgtcagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggcgacgtgatgctaatccctaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaaggagcgccctagggtaaaactggtgattggggctaagtcgtaacaaggtagccgt

SEQ ID NO: 316 - DNA, 1502 bp, Bacteroides sp.
  AR29
  modified_base (11)..(12): a, c, t, g, unknown or other
  modified_base (57)..(57): a, c, t, g, unknown or other
  modified_base (1000)..(1000): a, c, t, g, unknown or other
  modified_base (1008)..(1009): a, c, t, g, unknown or other
  modified_base (1023)..(1023): a, c, t, g, unknown or other
  modified_base (1026)..(1027): a, c, t, g, unknown or other
  modified_base (1033)..(1033): a, c, t, g, unknown or other
  modified_base (1038)..(1038): a, c, t, g, unknown or other
  modified_base (1045)..(1045): a, c, t, g, unknown or other
  modified_base (1057)..(1057): a, c, t, g, unknown or other
  modified_base (1060)..(1060): a, c, t, g, unknown or other
  modified_base (1068)..(1068): a, c, t, g, unknown or other
  modified_base (1091)..(1092): a, c, t, g, unknown or other
  modified_base (1097)..(1097): a, c, t, g, unknown or other
  modified_base (1125)..(1125): a, c, t, g, unknown or other
  modified_base (1127)..(1127): a, c, t, g, unknown or other
  modified_base (1135)..(1135): a, c, t, g, unknown or other
  modified_base (1137)..(1137): a, c, t, g, unknown or other
  modified_base (1144)..(1144): a, c, t, g, unknown or other
  modified_base (1155)..(1156): a, c, t, g, unknown or other
  modified_base (1306)..(1306): a, c, t, g, unknown or other
  modified_base (1350)..(1350): a, c, t, g, unknown or other
  modified_base (1435)..(1435): a, c, t, g, unknown or other
  modified_base (1480)..(1480): a, c, t, g, unknown or other
aataaagtttnnacgtgtggaattttgtatgtaccatatgaataaggatcggctaantccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatattttggaaacagtatagccgtaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaagcctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaagaaggcggctntctggacnntaactgacgctgangcnngaaagngtggngagcaancaggattagatnccntggtagtncacgccgtaaacgatgagtagtnngtgtnggggggttacccccctcggtgccgcaantnaagcattnantactccncctgggaaatnngctcgcaagagtgaaaatcaaaagaattgacggggagccccacaagtagcggagcatgtggtttaatttgaagcaacgcggaaaaccttacctaagtttgacattccattgacctttccataatcgaaaatttcccttcggggacagtgntaacaggtggggcatggtttttgtcagctcgtctcgtgaaatgnggggttaattcccccaacgcgcccacccctttcctttttttcccaccattaagttgggcactctagagagactgccgaggataantcggaggaaggtggggatgacgtcaaatcatcatgccccttatgnccagggctacacacgtgctaca

SEQ ID NO: 317 - DNA, 715 bp, Bacteroides sp.
  B2
  modified_base (650)..(650): a, c, t, g, unknown or other
taggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggangaacatgtggtttaattcgatgatacgcgaggaaccttacccgggcttaaattgcatttgaatat

SEQ ID NO: 318 - DNA, 1517 bp, Bacteroides sp.
  D1
agagtttgatcctggctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatggtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacct

SEQ ID NO: 319 - DNA, 1380 bp, Bacteroides sp.
  D20
  modified_base (8)..(9): a, c, t, g, unknown or other
  modified_base (12)..(12): a, c, t, g, unknown or other
ggggcagnntgnactgtagcttgctaagtttgatggcgaccggcgcacgggtgagtaacacgtatccaacctgccgatgactcggggatagcctttcgaaagaaagattaatacccgatggcataattcttccgcatggtagaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcctgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacatgtcagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggtgacgtgatgctaatccctaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaagg

SEQ ID NO: 320 - DNA, 1533 bp, Bacteroides sp.
  D22
ttacaatgaagagtttgatcctggctcaggatgaacgctagctacaggcttaacacatgcaagtcgaggggcagcattttagtttgcttgcaaactgaagatggcgaccggcgcacgggtgagtaacacgtatccaacctgccgataactcggggatagcctttcgaaagaaagattaatatccgatggtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtgggattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaataatctggaaacaggttagccgcaaggcatttgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctttct

SEQ ID NO: 321 - DNA, 1040 bp, Bacteroides sp.
  D2
  modified_base (15)..(15): a, c, t, g, unknown or other
  modified_base (17)..(19): a, c, t, g, unknown or other
  modified_base (33)..(33): a, c, t, g, unknown or other
  modified_base (35)..(36): a, c, t, g, unknown or other
  modified_base (42)..(42): a, c, t, g, unknown or other
gcgtgaaggatgaangnnntatgggtcgtaaantnnttttanatgggaataaagttttccacgtgtggaatttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgttactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaacagaatatattggaaacagtatagccgcaaggcagttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacccggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggag

SEQ ID NO: 322 - DNA, 1048 bp, Bacteroides sp.
  F-4
  modified_base (33)..(33): a, c, t, g, unknown or other
  modified_base (42)..(42): a, c, t, g, unknown or other
caagtagcgtgaaggatgactgccctatgggtngtaaacttnttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacatgtcagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggtgacgtgatgctaatcccgaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaaggagc

SEQ ID NO: 323 - DNA, 627 bp, Bacteroides sp.
  NB-8
  modified_base (407)..(407): a, c, t, g, unknown or other
  modified_base (490)..(490): a, c, t, g, unknown or other
  modified_base (512)..(512): a, c, t, g, unknown or other
  modified_base (515)..(515): a, c, t, g, unknown or other
gaactgagacacggtccaaactcctacgggaggcagcagtgaggaatattggtcaatggacgagagtctgaaccagccaagtagcgtgaaggatgaaggttctatggattgtaaacttcttttatacgggaataaacggatccacgtgtggatttttgcatgtaccgtatgaataaggatcggctaactccgtgccagcagccgcggtaatacggaggatccgagcgttatccggatttattgggtttaaagggagcgtagatgggttgttaagtcagttgtgaaagtttgcggctcaaccgtaaaattgcaattgatactggcagtcttgagtacagttgaggtaggcggaattcgtggtgtagcggtgaaatgcttagatatcacgaagaactccgattgcgaangcagcttactaacctgtaactgacattgatgctcgaaagtgtgggtatcaaacaggattagataccctggtagtccacacggnaaacgatgaatactcgctgtangcnatatacagtctgcggccaagcgaaagcattaagtattccacctggggagtacgcccggcacggtgaaactcaaaggaattgacgggggcccgcacaagcggaggaacatgtg

SEQ ID NO: 324 - DNA, 1361 bp, Bacteroides sp.
  WH2
agtcgaggggcagcatgacctagcaatagggttgatggggcgaccggcgcacggtgtgagtaacacgtatccaacctaccggttattccgggatagcctttcgaaagaaagattaataccggatagtataacgagaaggcatcttcttgttattaaagaatttcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtgagccacgtgtggctttttgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgtttgcgatatacggcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatatgaatattgtggaaacagaatagccgcaaggcagatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacacagcgatgtgatgctaatcccaaaagcctctctcagttcggattggagtctgcaacccgactccatgaagctggattcgctagtaatcgcgcatcagccacggcgcggtgaatacgttcccgggccttgtacacaccgcccgtcaagccatgaaagccggggg

SEQ ID NO: 325 - DNA, 1357 bp, Bacteroides sp.
  XB12B
cgaggggcagcatgacctagcaataggttgatggcgaccggcgcacgggtgagtaacacgtatccaacctaccggttattccgggatagcctttcgaaagaaagattaataccggatagtataacgagaaggcatctttttgttattaaagaatttcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtgagccacgtgtggctttttgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgtttgcgatatacagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatctgaataatttggaaacagattagccgcaaggcagatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacacagcgatgtgatgctaatcccaaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtac

SEQ ID NO: 326 - DNA, 1407 bp, Bacteroides sp.
  XB44A
  modified_base (42)..(42): a, c, t, g, unknown or other
gctcaggcttagccatgcaagtcgaggggcagcatgacttancaataggttgatggcgaccggcgcacgggtgagtaacacgtatccaacctgccgattattccgggatagcctttcgaaagaaagattaatactggatagcataacgagaaggcatcttcttgttattaaagaatttcgataatcgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttgtatgggaataaagtgagccacgtgtggctttttgtatgtaccatacgaataaggatcggctaactccgtgccagcagccgcggtaatacggaggatccgagcgttatccggatttattgggtttaaagggagcgtaggcggattattaagtcagttgtgaaagtttgcggctcaaccgtaaaattgcagttgatactggtagtcttgagtgcagcagaggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgtttgcgatatacagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaactgacggatttggaaacagatcttccttcgggcagttgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacacagcgatgtgatgctaatcccaaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacttgaagtacgtaaccgcaaggagcgtct

SEQ ID NO: 327 - DNA, 1261 bp, Bacteroides stercoris
atggtatagttttcccgcatgggataattattaaagaatttcggttgtcgatggggatgcgttccattaggcagttggcggggtaacggcccaccaaacctacgatggataggggttctgagaggaaggtcccccacattggaactgagacacggtccaaactcatacgggaggcagcagtgaggaatattggtcaatggacgagagtctgaaccagccaagtagcgtgaaggatgactgccctatgggttgtaaacttcttttatacgggaataaagttagccacgtgtggttttttgtatgtaccgtatgaataaggatcggctaactccgtgccagcagccgcggtaatacggaggatccgagcgttatccggatttattgggtttaaagggagcgtaggcgggttgttaagtcagttgtgaaagtttgcggctcaaccgtaaaattgcagttgatactggcgaccttgagtgcaacagaggtaggcggaattcgtggtgtagcggtgaaatgcttagatatcacgaagaactccgattgcgaaggcagcttactggattgtaactgacgctgatgctcgaaagtgtgggtatcaaacaggattagataccctggtagtccacacagtaaacgatgaatactcgctgttggcgatatacggtcagcggccaagcgaaagcattaagtattccacctggggagtacgccggcagcggtgaaactcaaaggaattgacgggggcccgcacaagcggaggaacatgtggtttaattcgatgatacgcgaggaaccttacccgggcttaaattgcaactgacggaatcggaaacggttctttcttcggacagttgtgaaggtgctgcatggttgtcgtcagctcgtgccgtgaggtgtcggcttaagtgccataacgagcgcaacccttacgggtagttaccatcaggttatgctggggactctacccggactgccgtcgtaagatgtgaggaaggtggggatgacgtcaaatcagcacggcccttacgtccggggctacacacgtgttacaatggggggtacagaaggcagctacacggcgacgtggtgctaatcccaaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtacgtaaccgcga

SEQ ID NO: 328 - DNA, 962 bp, Bacteroides thetaiotaomicron
  modified_base (754)..(755): a, c, t, g, unknown or other
  modified_base (946)..(948): a, c, t, g, unknown or other
  modified_base (951)..(951): a, c, t, g, unknown or other
tcgaggggcagcatttcagtttgcttgcaaactggagatggcgaccggcgcacgggtgagtaacacgtatccaacctgccgataactcggggatagcctttcgaaagaaagattaatacccgatggtataatgaaaccgcatggtcttattattaaagaatttcggttatcgatggggatgcgttccattaggcagttggtgaggtaacggctcaccaaaccttcgatggataggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtnncgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatatnnntgnaacagtatagc

SEQ ID NO: 329 - DNA, 1382 bp, Bacteroides uniformis
cgaggggcagcatgaacttagcttgctaagtttgatggcgaccggcgcacgggtgagtaacacgtatccaacctgccgatgactcggggatagcctttcgaaagaaagattaatacccgatggcatagttcttccgcatggtggaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggtttgaattgcaactgaatgatgtgagtacagtagagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggtgacgtgatgctaatcccgaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaagg

SEQ ID NO: 330 - DNA, 1370 bp, Bacteroides ureolyticus
gaggaacaacagttggaaacggctgctaatacctcatactcctatttgacataagttaaatagggaaagtcttttcggtgtaggatgagactatatcgtatcagctagttggtaaggtaatggcttaccaaggctatgacgcgtaactggtctgagaggatgatcagtcacattggaactgagacacggtccaaactcctacgggaggcagcagtaaggaatattgcgcaatgggggaaaccctgacgcagcaacgccgcgtggaggatgacacttttcggagcgtaaactccttttatcaggaaagaataatgacggtacctgatgaataagcaccggctaactccgtgccagcagccgcggtaatacggggggtgcaagcgttactcggaatcactgggcgtaaaggacgcgtaggcggattatcaagtcttttgtgaaatctagtggcttaaccactaaactgcttaggaaactgatagtctagagtaggggagaggtagatggaattcttggtgtaggggtaaaatccgtagagatcaagaagaatacccattgcgaaagcgatctgctggaacctaactgacgctgaggcgtgaaagcgtgggtagcaaacaggattagataccctggtagtccacgccctaaacgatgtatactagttgttgctttgctagtcaaggcagtaatgcagctaacgcattaagtataccgcctggggagtacggtcgcaagattaaaactcaaaggaatagacggggacccgcacaagcggtggagcatgtggtttaattcgaagatacgcgaagaaccttacctggacttgacatcctaaaaacatctaagagattagaaagtgctagtttactagaatttagtgacaggtgctgcacggctgtcgtcagctcgtgtcgtgagatgttgggttaagtcccgcaacgagcgcaacccacgtgtttagttgctaacagctcggctgagcactctaaacagactgccttcgtaaggaggaggaaggtgtggacgacgtcaagtcatcatggcccttatgtccagggcgacacacgtgctacaatgacatatacagtaagacgcaatatcgcaagatggagcaaatctataaaatatgtcccagttcggattgtggtctgcaactcgaccccatgaagccggaatcgctagtaatcgtagatcagccatgctacggtgaatacgttcccgggtcttgtactcaccgcccgtcacaccatggaagttgatctcactcgaagcagggatgctaaaatagctaccttccacagtggaatcagtaactggggtgaagtcgtaacaaggtaaccgtaggagaacctgcggttggatcacctcct

SEQ ID NO: 331 - DNA, 1388 bp, Bacteroides vulgatus
  modified_base (36)..(37): a, c, t, g, unknown or other
  modified_base (1072)..(1072): a, c, t, g, unknown or other
agtcgaggggcagcatggtcttagcttgctaagacnngatggcgaccggcgcacgggtgagtaacacgtatccaacctgccgtctactcttggacagccttctgaaaggaagattaatacaagatggcatcatgagtccgcatgttcacatgattaaaggtattccggtagacgatggggatgcgttccattagatagtaggcggggtaacggcccacctagtcttcgatggataggggttctgagaggaaggtcccccacattggaactgagacacggtccaaactcctacgggaggcagcagtgaggaatattggtcaatgggcgagagcctgaaccagccaagtagcgtgaaggatgactgccctatgggttgtaaacttcttttataaaggaataaagtcgggtatgcatacccgtttgcatgtactttatgaataaggatggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacgcaagcggccaagcgaaagcgttaagtattccacctggggagtacgccggcaacggtgaaactcaaaggaattgacgggggcccgcacaagcggaggaacatgtggtttaattcgatgattcgcgaggaaccttacccggtattaaattgcagatgaattacggtaaaagccgtaggccgcaaggcatctgtgaattgatactgggtatcttgacagctcgtgccgtgaggtgtcggcttaagtgccataacgagcgcaacccttgttgtcagttactaacaggttntgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatcccaaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggagc

SEQ ID NO: 332 - DNA, 1508 bp, Bacteroides xylanisolvens
agagtttgatcctggctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatagtatattaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctg

SEQ ID NO: 333 - DNA, 1481 bp, Bacteroidetes bacterium oral taxon D27
agagtttgatcctggctcaggatgaacgctagcggcaggcctaacacatgcaagtcgaggggtagtcccgatttatcgggatgagaccggcgcacgggtgcgtaacgcgtatgcaatctaccttatactaagggatagcccagagaaatttggattaataccttatagttaataaaaaaggcatctttttaattataaagattaattggtataagatgagcatgcgtcccattagttagttggtaaggtaacggcttaccaagacgatgatgggtaggggtcctgagagggagatcccccacactggtactgagacacggaccagactcctacgggaggcagcagtgaggaatattggtcaatgggcgcaagcctgaaccagccatgccgcgtgcaggatgacgcatctatggtgtgtaaactgcttttgtacaggaagaaacctcccgacgagtcgggacttgacggtactgtaagaataaggatcggctaactccgtgccagcagccgcggtaatacggaggatccaagcgttatccggaatcattgggcttaaagggtccgtaggcggcttaataagtcagcggtgaaagtttttggcttaaccaaaaaattgccattgatactgttaggcttgaatttttgtgaagtaactagaatatgtagtgtagcggtgaaatgcttagatattacatggaataccaattgcgaaggcaggttactaacaaacgattgacgctgatggacgaaagcgtgggtagcgaacaggattagataccctggtagtccacgccgtaaacgatggatactagctgttcgggcgtaagcttgagtggctaagcgaaagtgataagtatcccacctggggagtacgggcgcaagcctgaaactcaaaggaattgacgggagcccgcacaagcggtggagcatgtggtttaattcgatgatacgcgaggaaccttaccagggcttaaatgtattttgaccgtttaggaaactagactttcgcaagacaaaatacaaggtgctgcatggttgtcgtcagctcgtgccgtgaggtgtcaggttaagtcctataacgagcgcaacccctgttgttagttgccagcgagtcaagtcgggaactctaacaagactgccagtgtaaactgtgaggaaggtggggatgacgtcaaatcatcacggcccttacgtcctgggccacacacgtgctacaatggacggcacagagagcagctaccaggtgactggatgcgaatctataaaaccgttctcagttcggatcggagtctgcaactcgactccgtgaagctggaatcgctagtaatcggatatcagccatgatccggtgaatacgttcccgggccttgtacacaccgcccgtcaagccatggaagctgggggtacctgaagtcggtgaccgcaaggagctgcctagggtaaaactggtaactagggctaagtcgtaacaaggtagccgt

SEQ ID NO: 334 - DNA, 1481 bp, Bacteroidetes bacterium oral taxon F31
agagtttgatcctggctcaggatgaacgctagcggcaggcctaacacatgcaagtcgaggggtagaggaagcttgcttccttgagaccggcgcacgggtgcgtaacgcgtatgcaatctaccttgtacagggggatagcccagagaaatttggattaatacctcatagtgtttaagagtggcatcacttttttactaaagttccaacggtacaagatgagcatgcgtcccattagctagttggtgtggtaacggcataccaaggcaatgatgggtaggggtcctgagagggaggtcccccacactggtactgagacacggaccagactcctacgggaggcagcagtgaggaatattgggcaatggaggcaactctgacccagccatgccgcgtgcaggaagacggtcctatggattgtaaactgcttttgtacgagaagaaacatcccgacgtgtcgggacttgacggtatcgtaagaataaggatcggctaactccgtgccagcagccgcggtaatacggaggatccaagcgttatccggaatcattgggtttaaagggtccgtaggcggtcttataagtcagtggtgaaatctcctagctcaactaggaaactgccattgatactgtaagacttgaatgtttgtgaagtaactagaatatgtagtgtagcggtgaaatgcttagatattacatggaataccaattgcgaaggcaggttactaacagatgattgacgctgatggacgaaagcgtggggagcgaacaggattagataccctggtagtccacgccgtaaacgatggatactagctgttcgagagcaatcttgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccagggcttaaatgggagacgacagtttaggaaactagactttcttcggacgtctttcaaggtgctgcatggttgtcgtcagctcgtgccgtgaggtgtcaggttaagtcctataacgagcgcaacccctgttgttagttgccagcgagtaatgtcgggaactctagcaagactgccggtgtaaaccgtgaggaaggtggggatgacgtcaaatcatcacggcccttacgtcctgggccacacacgtgctacaatggcaggtacagagagcagccacttagcgataaggagcgaatctataaaacctgtctcagttcggattggagtctgcaactcgactctatgaagctggaatcgctagtaatcggatatcagccatgatccggtgaatacgttcccgggccttgtacacaccgcccgtcaagccatggaagctgggggtacctgaagtcggtgaccgtaaggagctgcctagggtaaaactagtaactggggctaagtcgtaacaaggtagccgt

SEQ ID NO: 335 - DNA, 1477 bp, Bacteroidetes bacterium oral taxon F44
aagtttgatcctggctcaggatgaacgctagcggcaggcctaacacatgcaagtcgaggggtagaagctttcgggctttgagaccggcgcacgggtgcgtaacgcgtatgcaatctgccttgtactgagggatagcccagagaaatttggattaatacctcatggtattttttgttggcatcaacagattattaaagagattcggtacaagatgagcatgcgtcccattagctagttggtatggtaacggcataccaaggctacgatgggtaggggtcctgagagggagatcccccacactggtactgagacacggaccagactcctacgggaggcagcagtgaggaatattggtcaatggtcgcaagactgaaccagccatgccgcgtgtaggatgaagcatctatggtgtgtaaactacttttgtacgggaagaaacactccctcgtgagggagcttgacggtaccgtaagaataaggatcggctaactccgtgccagcagccgcggtaatacggaggatccaagcgttatccggaatcattgggtttaaagggtccgtaggcggttttataagtcagtggtgaaatccggcagctcaactgtcgaactgccattgatactgtagaacttgaatcattgtgaagtaactagaatatgtagtgtagcggtgaaatgcttagatattacatggaataccaattgcgaaggcaggttactaacaatgtattgacgctgatggacgaaagcgtgggtagcgaacaggattagataccctggtagtccacgccgtaaacgatggatactagctgttcggttgtaagattgagtggctaagcgaaagtgataagtatcccacctggggagtacgggcgcaagcctgaaactcaaaggaattgacgggggcccgcacaagcggtggagcatgtggtttaattcgatgatacgcgaggaaccttaccagggcttaaatgtagtatgacaggtttggaaacagacttttcttcggacatattacaaggtgctgcatggttgtcgtcagctcgtgccgtgaggtgtcaggttaagtcctataacgagcgcaacccctgttgttagttgccatcgagtaatgtcgggaactctaacaagactgccggtgcaaaccgtgaggaaggtggggatgacgtcaaatcatcacggcccttacgtcctgggctacacacgtgctacaatggcaggtacagagagcagccacttcgcaaggaggagcgaatctataaagcctgtctcagttcggattggagtctgcaacccgactccatgaagctggaatcgctagtaatcggatatcagccatgatccggtgaatacgttcccgggccttgtacacaccgcccgtcaagccatggaagctgggggtacctgaagtcggtgaccgcaaggagctgcctagggtaaaactggtaactggggctaagtcgtaacaaggtagccgt

SEQ ID NO: 336 - DNA, 1316 bp, Barnesiella intestinihominis
gatgaacgctagcgacaggcctaacacatgcaagtcgagggaccggcgcacgggtgagtaacacgtatgcaatccacctgtaacagggggataacccggagaaatccggactaataccccataattaaagttggttacagacgagcatgcgctccattagccagttggcggggtaacggcccaccaaagcgacgatggataggggttctgagaggaaggtcccccacattggaactgagacacggtccaaactcctacgggaggcagcagtgaggaatattggtcaatggtcggcagactgaaccagccaagtcgcgtgagggaagacggcctacgggttgtaaacctcttttgtcggagagtatgcaagtatccgaagaaaaagcatcggctaactccgtgccagcagccgcggtaatacggaggatgcgagcgttatccggatttattgggtttaaagggtgcgtaggcggcacgccaagtcagcggtgaaatttccgggctcaacccggagtgtgccgttgaaactggcgagctagagtacacaagaggcaggcggaatgcgtggtgtagcggtgaaatgcatagatatcacgcagaaccccgattgcgaaggcagcctgctagggtgacagacgctgaggcacgaaagcgtgggtatcgaacaggattagataccctggtagtccacgcagtaaacgatgaatactaactgtttgcgtgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcgaggtgctgcatggttgtcgtcagctcgtgccgtgaggtgtcggcttaagtgccataacgagcgcaacccctatcgacagttactaacggccgaggactctgtcgagactgccggcgcaagccggaggaaggtggggatgacgtcaaatcagcacggcccttacgtccggggcgacacacgtgttacaatggcaggcagaaggcagccagtcagcaatgacgcgcgaatcccgcctgtctcagttcggatggagtctgcaacccgactccagaagctggattcgctagtaatcgcgcatcagccatggcgcggtgaatacgttcccgggccttgtacacaccgcccgtcaagccatggaagccgggagtacctgaagcatgcagcgtacgaaggtaataccggtaactggggctaagtcgtaacaaggtagccgtaccggaagg

SEQ ID NO: 337 - DNA, 1461 bp, Barnesiella viscericola
tcaggatgaacgctagcgacaggcctaacacatgcaagtcgaggggcagcgcggaggtagcaatacttctggcggcgaccggcgcacgggtgagtaacacgtatgcaatctgcctgtaacagggggataacccggagaaatccggcctaataccccataacgacatatcttcgcatggggagatgtctaaagagagcaatcttggttacagatgagcatgcggtccattagccagttggcggggtaacggcccaccaaagcgacgatggataggggttctgagaggaaggtcccccacattggaactgagacacggtccaaactcctacgggaggcagcagtgaggaatattggtcaatggtcggcagactgaaccagccaagtcgcgtgaaggaagacggccctacgggttgtaaacttcttttgtcggagagtaaagtgcgctacgcgtagcgtattgcaagtatccgaagaaaaagcatcggctaactccgtgccagcagccgcggtaatacggaggatgcgagcgttatccggatttattgggtttaaagggtgcgtaggcggcacgccaagtcagcggtgaaatgcccgggcttaacccgggagctgccgttgaaactgcgagctagcgtgcacaagaggcaggcggaatgcgtggtgtagcggtgaaatgcatagatatcacgcagaaccccgattgcgaaggcagcctgctagggtgcaacggacgctgaggcacgaaagcgtggggatcgaacaggattagataccctggtagtccacgcagtaaacgatgaatactaactgtttgcgatataatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcagggggaatatgggtgaaagtccatagccagcaatggtcgcctgcgaggtgctgcatggttgtcgtcagctcgtgccgtgaggtgtcggcttaagtgccataacgagcgcaaccctattgacagttactaacgggtcaagccgaggactctgtcgagactgccggcgcaagccgcgaggaaggtggggatgacgtcaaatcagcacggcccttacgtccggggcgacacacgtgttacaatggcaggtacagaaggcagccagtcagcaatgacgcgcgaatcccgaaaacctgtctcagttcggattggagtctgcaactcgactccatgaagctggattcgctagtaatcgcgcatcagccatggcgcggtgaatacgttcccgggccttgtacacaccgcccgtcaagccatggaagccgggagtacctgaagcatgcaaccgcaaggagcgtacgaaggtaataccggtaactggggctaagtc

SEQ ID NO: 338 - DNA, 1492 bp, Bartonella bacilliformis
ttcaacttgagagtttgatcctggctcagaacgaacgctggcggcaggcttaacacatgcaagtcgagcgcactctttttgagtgagcggcagacgggtgagtaacgcgtgggaatctacccatctctacggaataacacagagaaatttgtgctaataccgtatacgtccttcgggagaaagatttatcggagatggatgagcccgcgttggattagctagttggtgaggtaacggcccaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcaccggtgaagataatgacggtagccggagaagaagccccggctaacttcgtgccagcagccgcggtaatacgaagggggctagcgttgttcggatttactgggcgtaaagcgcatgtaggcggatatttaagtcagaggtgaaatcccagggctcaaccttggaactgcctttgatactggatgtctcgagtatggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggagagtggagacactttccttcagttaggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaaccgcaaggtcgagctaatctccaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaaggtgctgtgctaaccgcaaggaagcaggcaaccacggtagggtcagcgactggggtgaagtcgtaacaaggtagccgtaggggaacctgcggctggatcacctcctttct

SEQ ID NO: 339 - DNA, 1491 bp, Bartonella grahamii
tgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtcctttttggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatatttaagtcagaggtgaaatcccagggctcaaccctggaactgcctttgatactggatatcttgagtatggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaagga

SEQ ID NO: 340 - DNA, 1492 bp, Bartonella henselae
ttcaatatgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtccttagggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactgggtatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccagcatttggttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaaggtgctgtgctaaccgcaagggggcaggcaaccacggtagggtcagcgactggggtgaagtcgtaacaaggtagccgtaggggaacctgtggctggatcacctcctttct

SEQ ID NO: 341 - DNA, 1493 bp, Bartonella quintana
ttcaatatgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtccctctgggagaaagatttatcggaggtggatgagcccgcgttggattagctagttggtgaggtaagggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacgttaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactggatgtctcgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggtggtttactactcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggtgacaggtgctgcatggctgtcgtcagctcgtgtcgtgagatgttgggttaagtcccgcaacgagcgcaaccctcgcccttagttgccatcattaagttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttct

SEQ ID NO: 342 - DNA, 1228 bp, Bartonella tamiae
tttcggagtgagcggcagacgggtgagtaacacgtgggaatctacccatctctacggaataacacagagaaatttgtgctaataccgtatacgtccttatggagaaagatttatcggagatggatgagcccgcgttggattagctagttggtagggtaaaggcttaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacatttaagtcagaggtgaaatcccagggctcaaccctggaactgcctttgatactgggtgtcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcggacagtttactgttcggtggcgcagctaacgcattaaacattccgcctggggagtacggtcgcaagattaaaactcaaaggaattgacgggggcccgcccaagcggtggagcatgtggtttaattcgaagcaacgcgcagaaccttaccagcccttgacatcccgatcgcggttagtggagacactttccttcagttaggctggatcggtgacaggtgctgcatggctgtcgtcagctcgtgtcgtgagatgttgggttaagtcccgcaacgagcgcaaccctcgcccttagttgccatcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagtggaatcgctagtaatcgtgg

SEQ ID NO: 343 - DNA, 1324 bp, Bartonella washoensis
gcaagtcgagcgcactcttttagagtgagcggcaaacgggtgagtaacgcgtgggaatctacccctctctacggaataacacagagaaatttgtgctaataccgtatacgtcccttttgggagaaagatttatcggagatggatgagcccgcgttggattagctagttggtgaggtaacggcccaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggacatttaagtcagaggtgaaatcccagggctcaaccctggaactgcctttgatactgggtgtcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccatcattaagttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccg

SEQ ID NO: 344 - DNA, 1407 bp, Bdellovibrio sp.
  MPA
catgcaagtcgaacggggaaagctttcgggtgagtactagtggcgcacgggtgagtaacgcgtggataatctgcctttgagtgggggataactagtcgaaagattagctaataccgcataagaccacaggaactgaggttctaggggttaaaggtttttcgctcatagatgagtccgcgtgagattagctagttggtgaggtaacggctcaccaaggcgacgatctctaactggtctgagaggatgatcagtcacactggaactgagacacggtccagactcctacgggaggcagcagtagggaatattgcacaatggaggaaactctgatgcagcgacgccgcgtgagtgatgaaggctttcgggtcgtaaagctctgtcgcaggggaataacacaatgaatgtaccctgtaagaaaggatcggctaacttcgtgccagcagccgcggtaagacgagggatcctagcgttgttcggaattattgggcgtaaagcggatgtaggtggctttgtaagtcaggtgtgaaagcctagggctcaaccctagaagtgcatctgatactgcgaagcttgagtgtgggagaggatagtagaattcctggtgtagtggtgaaatacgtagatatcaggaggaataccggaggcgaaggcggctatctggcccaacactgacactgagatccgaaagcgtggggatcaaacaggattagataccctggtagtccacgccgtaaacgatggatacttgttgttggaggtattgaccccttcagtgacgaagctaacgcgttaagtatcccgcctggggagtacggtcgcaagattaaaactcaaagaaattgacgggggcccgcacaagcggtggagcatgtggtttaattcgatgcaacgcgaagaaccttacctaggcttgacatgtactggaagactggcagaaatgtcgtcgccttcgggccggtacacaggtgctgcatggctgtcgtcagctcgtgtcgtgagatgttgggttaagtcccgcaacgagcgcaacccctgcatttagttgccagcattcagttgggcactctagatggactgccggtgttaaaccggaggaaggtggggatgacgtcaagtcctcatggcccttatgcctagggctacacacgtgctacaatggtggttacagacggatgccaaaccgcaaggtggagctaatcctacaaaagccatctaagttcagattggtctctgcaactcgagaccatgaagttggaatcgctagtaatcgcggatcagaatgccgcggtgaatacgttcccgggccttgtacacaccgcccgtcacaccatgaaagttggttgtaccagaagtcgctgcgctaaccgtaaggaggcaggcgcccaaggtatggtcgatgattggggt

SEQ ID NO: 345 - DNA, 1289 bp, Bifidobacteriaceae sp.
  C1
cgctggcggcgtgcttaacacatgcaagtcgagcgagcggcgaacgggtgagtaatgcgtgactgacctgccctgaggtttggaatagctcctggaaacgggtggtaatgccggatgttgaaaagtgccttgggatggggtcgcgtcctatcaggtagtcggtggggtagtggcctaccgagcctacgacgggtagccggcctgagagggtgaccggccacattgggactgagatacggcccagactcctacgggaggcagcagtggggaatattgcgcaatgggggaaaccctgacgcagcgacgccgcgtgcgggatggaggccttcgggttgtgaaccgcttttgttagggagcatgagtgtacctttcgaataaggaccggctaactacgtgccagcagccgcggtaatacgtagggtccaagcgctgtccggaattattgggcgtaaagggctcgtaggcggttcgtcgcgtctggtgtgaaagcccattgcttaacggtgggtttgcgctggatacgggcgggcttgagtgcggtaggggagaacggaattcccggtgtaacggtggaatgtgtagatatcgggaagaacaccgatggcgaaggcagttctctgggccgactgacgctgaggagcgaaagcgtggggagcgaacaggattagataccctggtagtccacgctgtaaacggtggatgctggatgtggggcgttctgtgtcggagctaacgcgttaagcatcccgcctggggagtacggccgcaaggttaaaactcaaagaaattgacgggggcccgcacaagcggcggagcatgcggtttaattcgatgcaacgcgaagaaccttacctgggtttgacatgcacaggtggtgcatggccgtcgtcagctcgtgtcgtgagatgttgggtcaagtcccgcaacgagcgcaacccttgccctgtgttgccagcagctgggcactcacgggggaccgccggggttaacccggaggagggtggggatgacgtcaggtcatcatgccccttacgtccagggctacacgcatgctacaatggccggcagcgggatgcgatgtcgtgaggcggagcggatcccttccggtctcagttcggacggagcctgcaactcggctccggaaggtggagtcgctagtaatcgcggatcagcaacgccgcggtgaatgcgttcccgggccttgtacacaccgcccgtcaagtcatgaaagtcggcaacacccgaagcccgtgcctagggagcggtcgaaggtggggctggtgattggg

SEQ ID NO: 346 - DNA, 1021 bp, Bifidobacterium adolescentis
  modified_base (773)..(773): a, c, t, g, unknown or other
  modified_base (859)..(859): a, c, t, g, unknown or other
  modified_base (975)..(975): a, c, t, g, unknown or other
  modified_base (991)..(992): a, c, t, g, unknown or other
  modified_base (1015)..(1015): a, c, t, g, unknown or other
tcccaggagcttgctcctgggtgagagtggcgaacgggtgagtaatgcgtgaccgacctgccccatacaccggaatagctcttggaaacgggtggtaatgccggatgctccagttggatgcatgtccttctgggaaagattcatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgactgggagcaagcccttcggggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggaccattccacggtctccgtgtcgganccaacgcgttaagcatcccgcctggggagtacggccgcaaggctaaaactcaaagaaattgacgggggcccgcacaagcggcggancatgcggattaattcgatgcaacgcgaagaaccttacctgggcttgacatgttcccgacagccgtagagatacggtctcccttcggggcgggttcacaggtggtgcatggtcgtcntcagctcgtgtcgtgnnatgttgggttaagtcccgcaacnagcgca

SEQ ID NO: 347 - DNA, 1535 bp, Bifidobacterium angulatum
tttttgtggagggttcgattctggctcaggatgaacgctggcggcgtgcttaacacatgcaagtcgaacgggatcggctggagcttgctccggccgtgagagtggcgaacgggtgagtaatgcgtgaccgacctgccccgtacaccggaatagctcctggaaacgggtggtaatgccggatgctccagtccatcgcatggtggtctgggaaagattttatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgttggggagcaagccttcgggtgagtgtacccttcgaataagcaccggctaactacgtgccagcagccgcggtaatacgtagggtgcaagcgttatccggaattattgggcgtaaagagctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccattccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccccagagatggggcctcccttcggggcgggttcacaggtggtgcatggtcgtcgtcagctcgtgtcgtgagatgttgggttaagtcccgcaacgagcgcaaccctcgccccgtgttgccagcacatgatggtgggaactcacgggggaccgccggggttaactcggaggaaggtggggatgacgtcagatcatcatgccccttacgtccagggcttcacgcatgctacaatggccggtacaacgggatgcgacatggcgacatggagcggatccctgaaaaccggtctcagttcggattggagtctgcaacccgactccatgaaggcggagtcgctagtaatcgcgaatcagcaacgtcgcggtgaatgcgttcccgggccttgtacacaccgcccgtcaagtcatgaaagtgggtagcacccgaagccggtggcccaaccagttcgctggggggagccgtctaaggtgagactcgtgattgggactaagtcgtaacaaggtagccgtaccggaaggtgcggctggatcacctcctttct

SEQ ID NO: 348 - DNA, 1550 bp, Bifidobacterium animalis
tttttgtggagggttcgattctggctcaggatgaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgcccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattgggactaagtcgtaacaaggtagccgtaccggaaggtgcggctggatcacctcctttctacggaga

SEQ ID NO: 349 - DNA, 1056 bp, Bifidobacterium bifidum
  modified_base (764)..(764): a, c, t, g, unknown or other
  modified_base (850)..(850): a, c, t, g, unknown or other
  modified_base (919)..(919): a, c, t, g, unknown or other
  modified_base (961)..(961): a, c, t, g, unknown or other
  modified_base (985)..(985): a, c, t, g, unknown or other
  modified_base (989)..(989): a, c, t, g, unknown or other
  modified_base (993)..(993): a, c, t, g, unknown or other
  modified_base (1002)..(1002): a, c, t, g, unknown or other
  modified_base (1014)..(1014): a, c, t, g, unknown or other
  modified_base (1026)..(1026): a, c, t, g, unknown or other
  modified_base (1028)..(1029): a, c, t, g, unknown or other
  modified_base (1045)..(1045): a, c, t, g, unknown or other
ctttgcttggtggtgagagtggcgaacgggtgagtaatgcgtgaccgacctgccccatgctccggaatagctcctggaaacgggtggtaatgccggatgttccacatgatcgcatgtgattgtgggaaagattctatcggcgtgggatggggtcgcgtcctatcagcttgttggtgaggtaacggctcaccaaggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgtttgggagcaagccttcgggtgagtgtacctttcgaataagcgccggctaactacgtgccagcagccgcggtaatacgtagggcgcaagcgttatccggatttattgggcgtaaagggctcgtaggcggctcgtcgcgtccggtgtgaaagtccatcgcttaacggtggatctgcgccgggtacgggcgggctggagtgcggtaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggacgctggatgtggggcacgttccacgtgttccgtgtcgganctaacgcgttaagcgtcccgcctggggagtacggccgcaaggctaaaactcaaagaaattgacgggggcccgcacaagcggcggancatgcggattaattcgatgcaacgcgaagaaccttacctgggcttgacatgttcccgacgacgccaganatggcgtttcccttcggggcgggttcacaggtggtgcatggncgtcgtcagctcgtgtcgtgagangttngggntaagtcccncaacgagcgcanccctcgccccgngnngccagcacgttatggnggggaactcac

SEQ ID NO: 350 - DNA, 1535 bp, Bifidobacterium breve
tttttgtggagggttcgattctggctcaggatgaacgctggcggcgtgcttaacacatgcaagtcgaacgggatccatcgggctttgcctggtggtgagagtggcgaacgggtgagtaatgcgtgaccgacctgccccatgcaccggaatagctcctggaaacgggtggtaatgccggatgctccatcacaccgcatggtgtgttgggaaagcctttgcggcatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgttagggagcaaggcactttgtgttgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgatcccagagatggggtttcccttcggggcgggttcacaggtggtgcatggtcgtcgtcagctcgtgtcgtgagatgttgggttaagtcccgcaacgagcgcaaccctcgccccgtgttgccagcggattgtgccgggaactcacgggggaccgccggggttaactcggaggaaggtggggatgacgtcagatcatcatgccccttacgtccagggcttcacgcatgctacaatggccggtacaacgggatgcgacagtgcgagctggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgcgggagggagccgtctaaggtgaggctcgtgattgggactaagtcgtaacaaggtagccgtaccggaaggtgcggctggatcacctcctttct

SEQ ID NO: 351 - DNA, 1051 bp, Bifidobacterium catenulatum
  modified_base (817)..(817): a, c, t, g, unknown or other
  modified_base (935)..(935): a, c, t, g, unknown or other
  modified_base (966)..(967): a, c, t, g, unknown or other
  modified_base (978)..(978): a, c, t, g, unknown or other
  modified_base (1030)..(1030): a, c, t, g, unknown or other
  modified_base (1042)..(1043): a, c, t, g, unknown or other
tcgaacgggatccaggcagcttgctgcctggtgagagtggcgaacgggtgagtaatgcgtgaccgacctgccccatacaccggaatagctcctggaaacgggtggtaatgccggatgctccgactcctcgcatggggtgtcgggaaagatttcatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcaagccttcgggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggncgcaaggctaaaactcaaagaaattgacgggggcccgcacaagcggcggagcatgcggattaattcgatgcaacgcgaagaaccttacctgggcttgacatgttcccgacagccgtanagatgcggcctcccttcggggcgggttcacnntggtgcatggncgtcgtcagctcgtgtcgtgagatgttgggttaagtcccgcaacgagcgcancctcgccctgtnngccagcac

SEQ ID NO: 352 - DNA, 1539 bp, Bifidobacterium dentium
ttttcgtggagggttcgattctggctcaggatgaacgctggcggcgtgcttaacacatgcaagtcgaacgggatcccgggggttcgcctccgggtgagagtggcgaacgggtgagtaatgcgtgaccgacctgccccatacaccggaatagctcctggaaacgggtggtaatgccggatgctccggttggatgcatgtccttccgggaaaggttccatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgatcgggagcaagcccttcggggtgagtgtacccttcgaataagcaccggctaactacgtgccagcagccgcggtaatacgtagggtgcaagcgttatccggaattattgggcgtaaagggctcgtaggcggttcgtcgcgtccggtgtgaaagcccatcgcttaacggtgggtctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggccgtagagatacggcctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacagcgggatgcgacatggcgacatggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggcagcacccgaagccggtggcctaacccttctgtgggatggagccgtctaaggtgaggctcgtgattgggactaagtcgtaacaaggtagccgtaccggaaggtgcggctggatcacctcctttctacgg

SEQ ID NO: 353 - DNA, 1551 bp, Bifidobacterium gallicum
tttttgtggagggttcgattctggctcaggatgaacgctggcggcgtgcttaacacatgcaagtcgaacgggatccggccgagcttgtcttggctggtgagagtggcgaacgggtgagtaatgcgtgaccaacctgccttgtgcaccggaatagctcctggaaacgggtggtaataccggatgttccgctccatcgcatggtggtgtgggaaatgcttttgcggcatgggatggggtcgcgtcctatcagcttgttggcggggtgacggcccaccaaggctttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgattgtcagcaaggcgtcctttcggggatgttgagtgtagctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggccctttttccgggtcctgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttccggatcgccccagagatggggtttcccttcggggccggttcacaggtggtgcatggtcgtcgtcagctcgtgtcgtgagatgttgggttaagtcccgcaacgagcgcaaccctcgccgcgtgttgccagcgggtcatgccgggaactcacgtgggaccgccggggtcaactcggaggaaggtggggatgacgtcagatcatcatgccccttacgtccagggcttcacgcatgctacaatggccggtacaacgggatgcgacaccgtgaggtggggcggatccctgaaaaccggtctcagttcggatcgcagtctgcaacccgactgcgtgaaggcggagtcgctagtaatcgcagatcagcaacgctgcggtgaatgcgttcccgggccttgtacacaccgcccgtcaagtcatgaaagtgggtagcacccgaagccggtggcccgaccgccttgtgtggggggagccgtctaaggtgagactcgtgattgggactaagtcgtaacaaggtagccgtaccggaaggtgcggctggatcacctcctttctacgg

SEQ ID NO: 354 - DNA, 1400 bp, Bifidobacterium infantis
gattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagccgtggggagcgaacaggattagataccctggtagtccacgccgtaaacggtggatgctggatgtggggcccgttccacgggttccgtgtcggagctaacgcgttaagcatcccgcctggggagtacggccgcaagctaaaaactcaaagaaattgacgggggcccgcacaagcggcggagcatgcggattaattcgatcgaacgcgaagaaccttacctgggcttgacatgttcccgacggtcgtagagatacggcttcccttcggggcgggttcacaggtggtgcatggtcgtcgtcacgtcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggtagcacccg

SEQ ID NO: 355 - DNA, 1013 bp, Bifidobacterium kashiwanohense
  modified_base (19)..(19): a, c, t, g, unknown or other
  modified_base (21)..(21): a, c, t, g, unknown or other
  modified_base (29)..(29): a, c, t, g, unknown or other
  modified_base (45)..(47): a, c, t, g, unknown or other
  modified_base (947)..(947): a, c, t, g, unknown or other
gcgggatgacgccttcggntntaaaccgntttgatcgggagcaannncgggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgaccgctccagagatggggcttcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacaacgggatgcgacacggcgacgtggagcggatccctgaaaaccggtctcagttcggattggagtctgcaacccgactccatgaaggcggagtcgctagtaatcgcggatcagcaacgccgcggngaatgcgttcccgggccttgtacacaccgcccgtcaagtcatgaaagtgggtagcacccgaagccg

SEQ ID NO: 356 - DNA, 1346 bp, Bifidobacterium longum
cttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcagcgagagtgagtttacccgttgaataagcaccggcaactacgtgccagcagccgcggtaatacgtaggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaatcatcgctgggtctgcgccggttccgggcgggcttgagtgcgggagtgccgtctgggatggctggtgtgaggtgcatgggcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaacc

SEQ ID NO: 357 - DNA, 1357 bp, Bifidobacterium pseudocatenulatum
acgggatccatcaggctttgcttggtggtgagagtggcgaacgggtgagtaatgcgtgaccgacctgccccatacaccggaatagctcctggaaacgggtggtaatgccggatgctccggcctgccgcatggtgggctgggaaagattgtatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcaagccttcggggagtgtacctttcaataacaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggatcatgcggattaattcgatgcaacgcgaagaaccttacctgggcttgacatgttcccgaccgctccagagatggggcttcccttcggggaggctggaatgccgggtgtagcggtggaatagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacaacgggatgcgacacggcgacgtggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtg

SEQ ID NO: 358 - DNA, 1527 bp, Bifidobacterium pseudolongum
  modified_base (1526)..(1526): a, c, t, g, unknown or other
ttcgattctggctcaggatgaacgctggcggcgtgcttaacacatgcaagtcgaacgggatccctggcagcttgctgccggggtgagagtggcgaacgggtgagtaatgcgtgaccgacctgccccatgcaccggaatagctcctggaaacgggtggtaatgccggatgttccacatgagcgcatgcgagtgtgggaaaggcttttgcggcatgggatggggtcgcgtcctatcagcttgttggtggggtaacggcctaccaaggcgttgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcaagcgttatccggatttattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggccctttttccgggtcctgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgcctgacgatcccggagacggggtttcccttcggggcgggttcacaggtggtgcatggtcgtcgtcagctcgtgtcgtgagatgttgggttaagtcccgcaacgagcgcaaccctcgccgcgtgttgccagcgggtcatgccgggaactcacgtgggaccgccggggttaactcggaggaaggtggggatgacgtcagatcatcatgccccttacgtccagggcttcacgcatgctacaatggccggtacaacggggtgcgacacggtgacgtggggcggatccctgaaaaccggtctcagttcggatcgcagtctgcaactcgactgcgtgaaggtggagtcgctagtaatcgcggatcagcaacgccgcggtgaatgcgttcccgggccttgtacacaccgcccgtcaagtcatgaaagtgggcagcacccgaagacggtggcctaacccttgtggggggagccgtctaaggtgaggctcgtgattgggactaagtcgtaacaaggtagccgtaccggaaggtgcggctggatcacctcctna

SEQ ID NO: 359 - DNA, 1380 bp, Bifidobacterium scardovii
gaacgctggcggcgtgcttaacacatgcaagtcgaacgggatccggccagcttgctggttggtgagagtggcgaacgggtgagtaatgcgtgaccgacctgccccatgctccggaatagctcctggaaacgggtggtaatgccggatggtccagcatgctgcatggcgtgttgggaaagatttatcggcgtgggatggggtcgcgtcctatcagcttgacggtggggtgatggcctaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttagcagggagcaaggcttcggttgagtgtacctgttgaataagcaccggctaactacgtgccagcagccgcggtaatacgtagggtgcaagcgttatccggaattattgggcgtaaagggctcgtaggcggttcgtcgcgtctggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacggccccagagatggggcttcccttcggggcgggttcacaggtggtgcatggtcgtcgtcagctcgtgtcgtgagatgttgggttaagtcccgcaacgagcgcaaccctcgccccgtgttgccagcattttggatgggaactcacgggggaccgccggggttaactcggaggaaggtggggatgacgtcagatcatcatgcccctacgtccagggcttcacgcatgctacaatggccggtacaacgggatgcgacatggcgacatggagcggatccctgaaaaccggtctcagttcggattggagtctgcaacccgactccatgaaggcggagtcgctagtaatcgcgaatcagcaacgtcgcggtgaatgcgttcccgggccttgtacacaccgcccgtcaagtcatgaaagtgggcagcacc

SEQ ID NO: 360 - DNA, 1363 bp, Bifidobacterium sp.
  HM2
gggttcgattctggctcaggatgaacgctggcggcgtgcttaacacatgcaagtcgaacgagtggcgaacgggtgagtaatgcgtgaccgacctgccccatgcaccggaatagctcctggaaacgggtggtaatgccggatgctgaaaggcggcatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcatgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgactgacgctgaggagcgaaagcgtggggagcgaacaggattagataccctggtagtccacgccgtaaacggtggatgctggatgtggggcgttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgcacaggtggtgcatggtcgtcgtcagctcgtgtcgtgagatgttgggttaagtcccgcaacgagcgcaaccctcgccctgtgttgccagcacgtgggaactcacgggggaccgccggggtcaactcggaggaaggtggggatgacgtcagatcatcatgccccttacgtccagggcttcacgcatgctacaatggccggcaacgggatgcgacacggcgacgtggagcggatccctgccggtctcagttcggatggagtctgcaacccgactccagaaggcggagtcgctagtaatcgcggatcagcaacgccgcggtgaatgcgttcccgggccttgtacacaccgcccgtcaagtcatgaaagtgggtagcacccgaagccggtgcctatggagccgtctaaggtgagactcgtgattgggactaagtcgtaacaaggtagccgtaccggaaggtgcggctggatcacct

SEQ ID NO: 361 - DNA, 1245 bp, Bifidobacterium sp.
  HMLN12
  modified_base (28)..(28): a, c, t, g, unknown or other
  modified_base (792)..(792): a, c, t, g, unknown or other
  modified_base (1210)..(1210): a, c, t, g, unknown or other
  modified_base (1217)..(1217): a, c, t, g, unknown or other
  modified_base (1219)..(1219): a, c, t, g, unknown or other
  modified_base (1228)..(1228): a, c, t, g, unknown or other
  modified_base (1240)..(1241): a, c, t, g, unknown or other
aacgggagaggatgcgtgaccgacctgncccatgcaccggaatagctcctggaaacgggtggtaatgccggatgttccacatgagcgcatgcgagtgtgggaaaggcttttgcggcatgggatggggtcgcgtcctatcagcttgttggtggggtaacggcctaccaaggcgttgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcaagcgttatccggatttattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtgggaagcgaacaggattagataccctggtagtccacgccgtaaacggtggatgctggatgtggggccctttttccgggtcctgtgtcggagctaacgcgttaagcatcccgcctggggagtacggccgcaaggntaaaactcaaagaaattgacgggggcccgcacaagcggcggagcatgcggattaattcgatgcaacgcgaagaaccttacctgggcttgacatgtgcctgacgatcccggagacggggtttcccttcggggcgggttcacaggtggtgcatggtcgtcagctcgtgtcgtgagatgttgggttaagtcccgcaacgagcgcaaccctcgccgcgtgttgccagcgggtcatgccgggaactcacgtgggaccgccggggttaactcggaggaaggtggggatgacgtcagatcatcatgccccttacgtccagggcttcacgcatgctacaatggccggtacaacggggtgcgacacggtgacgtggggcggatccctgaaaaccggtctcagttcggatcgcagtctgcaactcgantgctaangngcggagtcnctagtaatcgcnnatca

SEQ ID NO: 362 - DNA, 1405 bp, Bifidobacterium sp.
  M45
  modified_base (1215)..(1215): a, c, t, g, unknown or other
gcttaccatgcagtcgaacgggatcccaggagcttgctcctgggtgagagtggcgaacgggtgagtaatgcgtgaccgacctgccccatacaccggaatagctcctggaaacgggtggtaatgccggatgctccagttgaatgcatgtccttctgggaaagattttgcggtatgggatggggtcgcgtcctatcagcttgatggcggggtaacggcccaccatggcttccacgggtagccggcctgagagggcgaccggccacattgggactgaaatacggcccagactcctacgggaggcagcagtggggaatattgcacaatgggcgcaagcctgatgcagcgacgccgcgtgcgggatgacggccttcgggttgtaaaccgcttttgactgggagcaagcccttcggggtgagtgtacctttcgaataagcaccggctaactacgtgccagcagccgcggtaatacgtagggtgcaagcgttatccggaattattgggcgtaaagggctcgtaagcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggaccattccacggtctccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccccagagatggggcctcccttcggggcgggttcacaggtggtgcatggtcgtcgtcagctcgtgtcgtgagatgttgggttaagtcccgcaacgagcgcaaccctcgccctgtgttgccagcacgtcgtggtgggaactcacgggggaccgccggggtcaactcggaggaaggtggggatgacgtcagatcatcatgccccttacgtccagggcttcacgcatgctacaatggccggtacaacgggatgcgacactgtgaggtggagcggntcccttaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcccaaccttttgggggagccgtctaag

SEQ ID NO: 363 - DNA, 1267 bp, Bifidobacterium sp.
  MSX5B
gctggcggcgtgcttaacacatgcaagtcgaacgagtggcgaacgggtgagtaatgcgtgaccgacctgccccatacaccggaatagctcctggaaacgggtggtaatgccggatgctgaaagtcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgaaggccttcgggttgtaaaccgcttttgatcgggagcatgagtgtacccttcgaataagcaccggctaactacgtgccagcagccgcggtaatacgtagggtgcaagcgttatccggaattattgggcgtaaagggctcgtaggcggttcgtcgcgtccggtgtgaaagcccatcgcttaacggtgggtctgcgccgggtacgggcgggctggagtgcggtaggggagactggaattcccggtgtaacggtggaatgtgtagatatcgggaagaacaccaatggcgaaggcaggtctctgggccgactgacgctgaggagcgaaagcgtggggagcgaacaggattagataccctggtagtccacgccgtaaacggtggatgctggatgtggggcgttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgcacaggtggtgcatggtcgtcgtcagctcgtgtcgtgagatgttgggttaagtcccgcaacgagcgcaaccctcgccctgtgttgccagcacgtgggaactcacgggggaccgccggggtcaactcggaggaaggtggggatgacgtcagatcatcatgccccttacgtccagggcttcacgcatgctacaatggccggcagcgggatgcgacatggcgacatggagcggatccctgccggtctcagttcggatggagtctgcaacccgactccagaaggcggagtcgctagtaatcgcggatcagcaacgccgcggtgaatgcgttcccgggccttgtacacaccgcccgtcaagtcatgaaagtgggcagcacccgaagccggtgcctatggagccgtct

SEQ ID NO: 364 - DNA, 1303 bp, Bifidobacterium sp.
  TM-7
tggctcaggatgaacgctggcggcgtgcttaacacatgcaagtcgaacgagtggcgaacgggtgagtaatgcgtgaccgacctgccccatacaccggaatagctcctggaaacgggtggtaatgccggatgctgaaagtcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgactgggagcatgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgactgacgctgaggagcgaaagcgtggggagcgaacaggattagataccctggtagtccacgccgtaaacggtggatgctggatgtggggatctccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgcacaggtggtgcatggtcgtcgtcagctcgtgtcgtgagatgttgggttaagtcccgcaacgagcgcaaccctcgccctgtgttgccagcacgtgggaactcacgggggaccgccggggtcaactcggaggaaggtggggatgacgtcagatcatcatgccccttacgtccagggcttcacgcatgctacaatggccggcaacgggatgcgacactgtgaggtggagcggatcccttccggtctcagttcggatggagtctgcaacccgactccagaaggcggagtcgctagtaatcgcggatcagcaacgccgcggtgaatgcgttcccgggccttgtacacaccgcccgtcaagtcatgaaagtgggtagcacccgaagccggtgcccagggagccgtctaaggtgagactcgtgattggg

SEQ ID NO: 365 - DNA, 1392 bp, Bifidobacterium thermophilum
tggctcaggatgaacgctggcggcgtgcttaacacatgcaagtcgaacgggatcctgcaagcttgcttgcgggtgagagtggcgaacgggtgagtaatgcgtgaccaacctgccccatgctccggaatagctcctggaaacgggtggtaatgccggatgtgccgggctcctgcatgggggtccgggaaagctctggcggcgtgggatggggtcgcgtcctatcagcttgttggcggggtgagggcccaccaaggcttcgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgtttgggagcaagcccttcggggtgagtgtacctttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgacggcggagacgtcgtttcccttcggggcgggttcacaggtggtgcatggtcgtcgtcagctcgtgtcgtgagatgttgggtcaagtcccgcaacgagcgcaaccctcgccccgtgttgccagcgcgtcatggcgggaactcacgggggaccgccggggttaacccgggaggaaggtggggatgacgtcagatcatcatgccccttacgtccagggcttcacgcatgctacaatggccggtacaacgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggcagc

SEQ ID NO: 366 - DNA, 1412 bp, Bifidobacterium urinalis
ctggctcaggacgaacgctggcggcgtgcttaacacatgcaagtcgaacgggatcctttcaagcttgctaggggggtgagagtggcgaacgggtgagtaacgcgtgattaacctgccgtgtagtttggaatagctcctggaaacgggtggtaatgccgaatgttccacatgctcgcatgggtgtgtgggaaaacgttttagtgctatgcgatgggatcgcgtcctatcagcttgttggtggggtagtggcctaccaaggcttcgacgggtagccggcctgagagggcgaccggccacattgggactgagatacggcccagactcctacgggaggcagcagtggggaatattgcacaatggggggaaccctgatgcagcgacgccgcgtgcgggatgacggccttcgggttgtaaaccgcttttattggggagcaagcgtgagtgagtgtaccttttgaataagcaccggctaactacgtgccagcagccgcggtaatacgtagggtgcaagcgttgtccggaattattgggcgtaaagagctcgtaggcggtttgtcgcgtctggtgtgaaagtccatcgcttaacggtggattggcgcttggtacgggcaggctagagtgtagtaggggagactggaattctcggtgtaacggtggaatgtgtagatatcgggaagaacaccaatggcgaaggcaggtctctgggctattactgacgctgaggagcgaaagcgtggggagcgaacaggattagataccctggtaatccacgccgtaaacggtggatgctggatgtggggccctttccacgggttctgtgtcggagctaacgcgttaagcatcccgcctggggagtacggccgcaaggctaaaactcaaagaaattgacgggggcccgcacaagcggcggagcatgcggattaattcgatgcaacgcgaagaaccttaccaagacttgacatgttaacgatggcctcagagatggggtgtctcttcggagcgttttcacaggtggtgcatggtcgtcgtcagctcgtgtcgtgagatgttgggttaagtcccgcaacgagcgcaacccttgtcttgtgttgccagcacgttatggtgggaactcacaagagaccgccggggttaactcggaggaaggtggggatgacgtcagatcatcatgccccttacgtcttgggcttcacgcatgctacaatggccggtacagcgaggtgcgatagggtgacctggagcggatctctgaaaaccggtctcagttcggatcggagcctgcaactcggctccgtgaaggtggagtcgctagtaatcgcagatcagcaacgctgcggtgaatgcgttcccgggccttgtacacaccgcccgtcaagtcatgaaagtgggcagcacccgaagccggtggccta

SEQ ID NO: 367 - DNA, 1551 bp, Bilophila wadsworthia
tcaactggagagtttgattctggctcagattgaacgctggcggcgtgcttaacacatgcaagtcgaacgtgaaagtccttcggggcgagtaaagtggcgcacgggtgagtaacgcgtggataatctacccttaagatggggataacggctggaaacggtcgctaataccgaatacgctcccgattttatcgttggggggaaagatggcctctgcttgcaagctatcgcttaaggatgagtccgcgtcccattagctagttggcggggtaacggcccaccaaggcgacgatgggtagccggtctgagaggatgaccggccacactggaactggaacacggtccagactcctacgggaggcagcagtggggaatattgcgcaatgggcgaaagcctgacgcagcgacgccgcgtgagggatgaaggttctcggatcgtaaacctctgtcaggggggaagaaaccccctcgtgtgaataatgcgagggcttgacggtacccccaaaggaagcaccggctaactccgtgccagcagccgcggtaatacggagggtgcaagcgttaatcggaatcactgggcgtaaagcgcacgtaggcggcttggtaagtcaggggtgaaatcccacagcccaactgtggaactgcctttgatactgccaggcttgagtaccggagagggtggcggaattccaggtgtaggagtgaaatccgtagatatctggaggaacaccggtggcgaaggcggccacctggacggtaactgacgctgaggtgcgaaagcgtgggtagcaaacaggattagataccctggtagtccacgctgtaaacgatgggtgctgggtgctgggatgtatgtctcggtgccgtagctaacgcgataagcaccccgcctggggagtacggtcgcaaggctgaaactcaaagaaattgacgggggcccgcacaagcggtggagtatgtggtttaattcgatgcaacgcgaagaaccttacccaggcttgacatctagggaacccttcggaaatgaaggggtgcccttcggggagccctaagacaggtgctgcatggctgtcgtcagctcgtgccgtgaggtgttgggttaagtcccgcaacgagcgcaacccctatcttcagttgccagcaggtaaggctgggcactctggagagaccgccccggtcaacggggaggaaggtggggacgacgtcaagtcatcatggcccttacgcctggggctacacacgtactacaatggcgcgcacaaagggtagcgagaccgcgaggtggagccaatcccaaaaaacgcgtcccagtccggattggagtctgcaactcgactccatgaagtcggaatcgctagtaattcgagatcagcatgctcgggtgaatgcgttcccgggccttgtacacaccgcccgtcacaccacgaaagtcggttttacccgaagccggtgagctaactcgcaagaggagcagccgtctacggtagggccgatgattggggtgaagtcgtaacaaggtagccgtaggggaacctgcggctggatcacctcctt

SEQ ID NO: 368 - DNA, 1296 bp, Bisgaard Taxon
attgaacgctggcggcaggcttaacacatgcaagtcgaacgagtggcggacgggtgagtaatgcttgggaatctggcttatggagggggataactgcgggaaactgcagctaataccgcgtattgaaagctgccataagatgagcccaagtgggattaggtagttggtggggtaaaggcctaccaagccgacgatctctagctggtctgagaggatgaccagccacactgggactgagacacggcccagactcctacgggaggcagcagtggggaatattgcgcaatgggggaaaccctgacgcagccatgccgcgtgaatgaagaaggccttcgggttgtaaagttctttcggtaatgaggatgacgttaattacagaagaagcaccggctaactccgtgccagcagccgcggtaatacggagggtgcgagcgttaatcggaataactgggcgtaaagggcccgcaggcggacttttaagtgagatgtgaaatccctgggcttaacctaggaactgcatttcagactgggagtctagagtactttagggaggggtagaattccacgtgtagcggtgaaatgcgtagagatgtggaggaataccgaaggcgaaggcagccccttgggaatactgacgctcatgtgcgaaagcgtggggagcaaacaggattagataccctggtagtccacgctgtaaacgctgtcgatttggggattgggcttggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcgatcgggaactcaaaggagactgccagtgacaaactggaggaaggtggggatgacgtcaagtcatcatggcccttacgagtagggctacacacgtgctacaatggtgcacagagggcggcgagacggcgacgttgagcgaatctcagtgcatctaagtccggatggagtctgcaactcgactccagaagtcggaatcgctagtaatcgcaaatcagaatgttgcggtgaatacgttcccgggccttgtacacaccgcccgtcacaccatgggagtgggttgtaccagaagtagatgcttagggcgtttaccacggtatgattcatgactggggtg

SEQ ID NO: 369 - DNA, 1296 bp, Bisgaard Taxon; identical to SEQ ID NO: 368

SEQ ID NO: 370 - DNA, 1296 bp, Bisgaard Taxon; identical to SEQ ID NO: 368

SEQ ID NO: 371 - DNA, 1296 bp, Bisgaard Taxon; identical to SEQ ID NO: 368

SEQ ID NO: 372 - DNA, 1477 bp, Blastomonas natatoria
agagtttgatcctggctcagaacgaacgctggcggcatgcctaacacatgcaagtcgaacgaaggcttcggccttagtggcgcacgggtgcgtaacgcgtgggaatctgcccttgggttcggaataacagtgagaaattactgctaataccggatgatgacttcggtccaaagatttatcgcccaaggatgagcccgcgtaagattagctagttggtgaggtaaaggctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggccattcaagtcagaggtgaaagcccggggctcaaccccggaactgcctttgaaactagatggcttgaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtctagtatgtttcccagagatgggttacttcagttcggctggctagaacacaggtgctgcatggctgtcgtcagctcgtgtcgtgagatgttgggttaagtcccgcaacgagcgcaaccctcgtctttagttgccatcatttagttgggcactctaaagaaaccgccggtgataagccggaggaaggtggggatgacgtcaagtcctcatggcccttacacgctgggctacacacgtgctacaatggcggtgacagtgagcagctagatcgcgagatcatgctaatctcaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggttcagcgactggggtgaagtcgtaacaaggtagccgtaggggaacctgcggctggatcacct

SEQ ID NO: 373 - DNA, 1493 bp, Blautia coccoides
agagtttgatcctggctcaggatgaacgctggcggcgtgcttaacacatgcaagtcgagcgaagcgctaagacagatttcttcggattgaagtctttgtgactgagcggcggacgggtgagtaacgcgtgggtaacctgcctcatacagggggataacagttagaaatgactgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgttgttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccgtcccgtaacgggggcttcccttcggggcagaggagacaggtggtgcatggttgtcgtcagctcgtgtcgtgagatgttgggttaagtcccgcaacgagcgcaacccttatccttagtagccagcacatgatggtgggcactctagggagactgccggggataacccggaggaaggcggggacgacgtcaaatcatcatgccccttatgatttgggctacacacgtgctacaatggcgtaaacaaagggaagcgagacagcgatgttgagcgaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgaaaggaaggagctgccgaaggcgggaccgataactggggtgaagtcgtaacaaggtaacc

SEQ ID NO: 374 - DNA, 1362 bp, Blautia glucerasea
  modified_base (944)..(944): a, c, t, g, unknown or other
tggaagcttcggtggaaatagcttgttcctagtggcggacgggtgagtaacgcgtgggtaacctgcctcacactgggggataacagtcagaaatgactgctaataccgcataagcgcacgggattgcatgatccagtgtgaaaaactccggtggtgtgagatggacccgcgttggattagccagttggcagggtaacggcctaccaaagcgacgatccatagccggcctgagagggtggacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggagcagcaagtctgatgtgaaaggcaggggctcaacccctggactgcattggaaactgttgatcttgagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtgcagagccattcggtgccgcagcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctatgaccggcgagtaacgtcgccttttcttcggagcngaggagacaggtggtgcatggttgtcgtcagctcgtgtcgtgagatgttgggttaagtcccgcaacgagcgcaacccctatccttagtagccagcggtttggccgggcactctgaggagactgccagggataacctggaggaaggcggggatgacgtcaaatcatcatgccccttatgatttgggctacacacgtgctacaatggcgtaaacaaagggaagcgagagtgtgagcttaagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgaccgaaccgaaagg

SEQ ID NO: 375 - DNA, 1026 bp, Blautia glucerasei
  modified_base (10)..(10): a, c, t, g, unknown or other
  modified_base (37)..(39): a, c, t, g, unknown or other
  modified_base (861)..(861): a, c, t, g, unknown or other
  modified_base (932)..(934): a, c, t, g, unknown or other
  modified_base (941)..(943): a, c, t, g, unknown or other
  modified_base (950)..(951): a, c, t, g, unknown or other
  modified_base (953)..(953): a, c, t, g, unknown or other
  modified_base (957)..(957): a, c, t, g, unknown or other
  modified_base (965)..(965): a, c, t, g, unknown or other
  modified_base (967)..(967): a, c, t, g, unknown or other
  modified_base (970)..(972): a, c, t, g, unknown or other
  modified_base (991)..(992): a, c, t, g, unknown or other
  modified_base (1019)..(1019): a, c, t, g, unknown or other
cgaacggggnacattttattggaagcttcggctaggnnntatagcttgttcctagtggcggacgggtgagtaacgcgtgggtaacctgcctcacactgggggataacagtcagaaatgactgctaataccgcataagcgcacgggattgcatgatccagtgtgaaaaactccggtggtgtgagatggacccgcgttggattagccagttggcagggtaacggcctaccaaagcgacgatccatagccggcctgagagggtggacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggagcagcaagtctgatgtgaaaggcaggggctcaacccctggactgcattggaaactgttgatcttgagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgcagcaaacgcagtaagtattccacctggggagtacgttcgcaagaatgaaactcaaaggaattgacgggganccgcacaagcggtggagcatgtggtttaattcgaagcaacgcgaagaaccttaccaagtcttgacatcccnnngaccggnnngtaacgnngncttnctcttcgnancannngagacaggtggtgcatggnngtcgtcagctcgtgtcgtgagatgttnggttaag

SEQ ID NO: 376 - DNA, 1157 bp, Blautia hansenii
agagtttgatcctggctcaggatgaacgctggcggcgtgcttaacacatgcaagtcgagcgaagcacttatcattgactcttcggaagatttgatatttgactgagcggcggacgggtgagtaacgcgtgggtaacctgcctcatacaggggaataacagttagaaatggctgctaatgccgcataagcgcacaggatcgcatggtctggtgtgaaaaactgaggtggtatgagatggacccgcgtctgattaggtagttggtggggtaacggcctaccaagccgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggtgcaaagcagttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatctgcctgaccgttccttgaccggagctttccttcgggacaggcaagacaggtggtgcatggttgtcgtcagctcgtgtcgtgagatgttgggttaagtcccgcaacgagcgcaacccctatccttagtagccagcagttcggctgggcactctagggagactgccggggataacccgg

SEQ ID NO: 377 - DNA, 975 bp, Blautia hydrogenotrophica
  modified_base (23)..(23): a, c, t, g, unknown or other
  modified_base (947)..(947): a, c, t, g, unknown or other
  modified_base (952)..(953): a, c, t, g, unknown or other
  modified_base (963)..(964): a, c, t, g, unknown or other
tttcggttgaagttttctattgnctgagtggcggacgggtgagtaacgcgtgggtaacctgccctatacagggggataacagttagaaatgactgctaataccgcataagcgcacagcttcgcatgaagcggtgtgaaaaactgaggtggtataggatggacccgcgttggattagctagttggtgaggtaacggcccaccaaggcgacgatccatagccggcctgagagggtgaacggccacattgggactgagacacggcccaaactcctacgggaggcagcagtggggaatattgcacaatgggggaaaccctgatgcagcgacgccgcgtgaaggaagaagtatctcggtatgtaaacttctatcagcagggaagaaagtgacggtacctgactaagaagccccggctaattacgtgccagcagccgcggtaatacgtaaggggcaagcgttatccggatttactgggtgtaaagggagcgtagacggtttggcaagtctgatgtgaaaggcatgggctcaacctgtggactgcattggaaactgtcagacttgagtgccggagaggcaagcggaattcctagtgtagcggtgaaatgcgtagatattaggaggaacaccagtggcgaaggcggcctgctggacggtaactgacgttgaggctcgaaagcgtggggagcaaacaggattagataccctggtagtccacgctgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccgggaagtaatgttcccttttcttcggaacagagganacagnnggtgcatggnngtcgtcagctc

SEQ ID NO: 378 - DNA, 998 bp, Blautia luti
  modified_base (33)..(33): a, c, t, g, unknown or other
  modified_base (765)..(767): a, c, t, g, unknown or other
  modified_base (771)..(775): a, c, t, g, unknown or other
  modified_base (915)..(916): a, c, t, g, unknown or other
  modified_base (929)..(929): a, c, t, g, unknown or other
  modified_base (940)..(940): a, c, t, g, unknown or other
  modified_base (949)..(949): a, c, t, g, unknown or other
  modified_base (958)..(958): a, c, t, g, unknown or other
  modified_base (966)..(968): a, c, t, g, unknown or other
  modified_base (972)..(973): a, c, t, g, unknown or other
  modified_base (975)..(976): a, c, t, g, unknown or other
  modified_base (979)..(979): a, c, t, g, unknown or other
  modified_base (981)..(981): a, c, t, g, unknown or other
  modified_base (984)..(985): a, c, t, g, unknown or other
  modified_base (991)..(992): a, c, t, g, unknown or other
tcgaacgggaattactttattgaaacttcggtngatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggnnncatnnnnncttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccanntcttgacatcccnctgaccggatnctttaatcnggatctttnccttcggnnnaganngnnacngnggnncatggnngtcgtc

SEQ ID NO: 379 - DNA, 1393 bp, Blautia producta
  modified_base (10)..(10): a, c, t, g, unknown or other
  modified_base (15)..(16): a, c, t, g, unknown or other
  modified_base (42)..(42): a, c, t, g, unknown or other
agcgaagcancttgnncggatttcttcggattgaagtttttngtgactgagcggcggacgggtgagtaacgcgtgggtaacctgcctcatacagggggataacagttagaaatggctgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccggcccgtaacggggccttcccttcggggcagaggagacaggtggtgcatggttgtcgtcagctcgtgtcgtgagatgttgggttaagtcccgcaacgagcgcaacccctatccttagtagccagcaggtgaagctgggcactctagggagactgccggggataacccggaggaaggcggggacgacgtcaaatcatcatgccccttatgatttgggctacacacgtgctacaatggcgtaaacaaagggaagcgagacagcgatgttgagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagttcagtgacccaaccttataggagggagct

SEQ ID NO: 380 - DNA, 1366 bp, Blautia schinkii
tgacagagacttcggttgaagtcgttataatcctagtggcggacgggtgagtaacgcgtgggtaacctgcctcacactgggggataacagtcagaaatgactgctaataccgcataagcgcacggggctgcatggttcagtgtgaaaaactccggtggtgtgagatggacccgcgttggattagccagttggcagggtaacggcctaccaaagcgacgatccatagccggcctgagagggtggacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgtatccggatttactgggtgtaaagggagcgtagacggagcagcaagtctgatgtgaaaggcgggggctcaacccccggactgcattggaaactgttgatcttgagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgcagcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctatgaccggtgagtaacgtcacctttccttcgggacagaggagacaggtggtgcatggttgtcgtcagctcgtgtcgtgagatgttgggttaagtcccgcaacgagcgcaacccctatccttagtagccagcggtttggccgggcactctgaggagactgccagggataacctggaggaaggcggggatgacgtcaaatcatcatgccccttatgatttgggctacacacgtgctacaatggcgtaaacaaagggaagcgagagtgtgagcttaagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgaccgaaccgaaagg

SEQ ID NO: 381 - DNA, 1015 bp, Blautia sp.
  M25
  modified_base (77)..(77): a, c, t, g, unknown or other
gaaggaagaagtatctcggtatgtaaacttctatcagcagggaagataatgacggtacctgactaagaagccccggnctaactacgtgccagcagccgcggtaatacgtagggggcgagcgttatccggatttactgggtgtaaagggagcgtagacggcgtatcaagtctgatgtgaaaggcaggggcttaacccctggactgcattggaaactggtatgcttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtctgggagcacagctcttaggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaaatcttgacatccctctgacagagtatgtaatgtacttttccttcgggacaggggagacaggtggtgcatggttgtcgtcagctcgtgtcgtgagatgttgggttaagtcccgcaacgagcgcaacccctatccttagtagccagcaagtaatgttgggcactctgaggagactgccagggataacctggaggaaggcggggatgacgtcaaatcatcatgccccttatgatttgggctacacacgtgctacaatggcgtaaacaaagggaagcgaacctgtgagggtgggcaaatctcaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgac

SEQ ID NO: 382 - DNA, 1372 bp, Blautia stercoris
tgcaagtcgagcgaagcgcttacgacagaaccttcgggggaagatgtaagggactgagcggcggacgggtgagtaacgcgtgggtaacctgcctcatacagggggataacagttggaaacggctgctaataccgcataagcgcacggtatcgcatgatacagtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgatctgaccggttcgtaatggaacctttccttcgggacagagaagacaggtggtgcatggttgtcgtcagctcgtgtcgtgagatgttgggttaagtcccgcaacgagcgcaacccctatcctcagtagccagcaggtgaagctgggcactctgtggagactgccagggataacctggaggaaggcggggacgacgtcaaatcatcatgccccttatgatttgggctacacacgtgctacaatggcgtaaacaaagggaagcgagcccgcgagggggagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtc

SEQ ID NO: 383 - DNA, 1375 bp, Blautia wexlerae
  modified_base (12)..(13): a, c, t, g, unknown or other
  modified_base (17)..(17): a, c, t, g, unknown or other
  modified_base (21)..(21): a, c, t, g, unknown or other
  modified_base (27)..(27): a, c, t, g, unknown or other
  modified_base (47)..(47): a, c, t, g, unknown or other
  modified_base (917)..(917): a, c, t, g, unknown or other
  modified_base (958)..(958): a, c, t, g, unknown or other
tcgaacgggaanntatnttcnattganacttcggtggatttagattntatttcgtagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccacagccgcgaagggggcagcgttatccggatttactgggtgtaaagggagcgtagacggtgtggcaagttgatgtgaaaggcatgggctcaacctgtggatgcattggaaactgtcatacttgagtgccggaggggtaagcggaattctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaccttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccnatttaacgggtcttaaaggggcgtttacgttggggaaagtntgatatgagaggcatgtgcttaacctgctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaag

SEQ ID NO: 384 - DNA, 1464 bp, Bordetella bronchiseptica
  modified_base (87)..(87): a, c, t, g, unknown or other
  modified_base (160)..(160): a, c, t, g, unknown or other
  modified_base (243)..(243): a, c, t, g, unknown or other
  modified_base (331)..(331): a, c, t, g, unknown or other
  modified_base (380)..(380): a, c, t, g, unknown or other
  modified_base (958)..(958): a, c, t, g, unknown or other
  modified_base (1287)..(1287): a, c, t, g, unknown or other
  modified_base (1391)..(1391): a, c, t, g, unknown or other
  modified_base (1409)..(1409): a, c, t, g, unknown or other
aactgaagagtttgatcctggctcagattgaacgctggcgggatgctttacacatgcaagtcggacggcagcacgggcttcggcctngtggcgagtggcgaacgggtgagtaatgtatcggaacgtgcccagtagcgggggataactacgcgaaagcgtngctaataccgcatacgccctacgggggaaagcgggggaccttcgggcctcgcactattggagcggccgatatcggattagctngttggtggggtaacggcctaccaaggcgacgatccgtagctggtttgagaggacgaccagccacactgggactgagacacggcccagnctcctacgggaggcagcagtggggaattttggacaatgggggcaacccngatccagccatcccgcgtgtgcgatgaaggccttcgggttgtaaagcacttttggcaggaaagaaacggcacgggctaatatcctgtgcaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagggcttaaccttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatncaacgcgaaaaaccttacctacccttgacatgtctggaatcccgaagagatttgggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtngtccggatcgcagtctgcaactcgactgcgtgaagtcggaatcgctagtaatcgcggatcagcatgtcgcggtgaatacgttcccgggtcttgtacacaccgcncgtcacaccatgggagtnggttttaccagaagtagttagcctaaccgcaaggggggcgattaccacggtagga

SEQ ID NO: 385 - DNA, 1292 bp, Bordetella holmesii
attgaacgctggcgggatgctttacacatgcaagtcggacgagtggcgaacgggtgagtaatgtatcggaacgtgcccggtagcgggggataactacgcgaaagcgtggctaataccgcatacggaaaggcactattggagcggccgatatcggattagctagttggtggggtaacggcctaccaaggcgacgatccgtagctggtttgagaggacgaccagtcacactgggactgagacacggcccagactcctacgggaggcagcagtggggaattttggacaatgggggcaaccctgatccagccatcccgcgtgtgcgatgaaggccttcgggttgtaaagcacttttggcaggaaagatgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagggcttaaccttggaactgcatttttaactaccgagctagagtgtgtcagagggaggtggaattccgcgtgtagcagtgaaatgcgtagatatgcggaggaacaccgatggcgaaggcagcctcctgggataactgacgctcatgcacgaaagtgtggggagcaaacaggattagataccctggtagtccacgccctaaacgatgtcaactagctgttggggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgcacaggtgctgcatggctgtcgtcagctcgtgtcgtgagatgttgggttaagtcccgcaacgagcgcaacccttgtcattagttgctacggcactctaatgagactgccggtgacaaaccggaggaaggtggggatgacgtcaagtcctcatggcccttatgggtagggcttcacacgtcatacaatggtcggcagagggttgccaacccgcgagggggagccaatcccagccggtcgtagtccggacgcagtctgcaactcgactgcggaagtcggaatcgctagtaatcgcggatcagcatgtcgcggtgaatacgttcccgggtcttgtacacaccgcccgtcacaccatgggagtgggttttaccagaagtagttgcctagggcgattaccacggtaggattcatgactggggtgaa

SEQ ID NO: 386 - DNA, 1464 bp, Bordetella parapertussis
  modified_base (87)..(87): a, c, t, g, unknown or other
  modified_base (243)..(243): a, c, t, g, unknown or other
  modified_base (331)..(331): a, c, t, g, unknown or other
  modified_base (1229)..(1229): a, c, t, g, unknown or other
  modified_base (1371)..(1371): a, c, t, g, unknown or other
  modified_base (1391)..(1391): a, c, t, g, unknown or other
aactgaagagtttgatcctggctcagattgaacgctggcgggatgctttacacatgcaagtcggacggcagcacgggcttcggcctngtggcgagtggcgaacgggtgagtaatgtatcggaacgtgcccagtagcgggggataactacgcgaaagcgtagctaataccgcatacgccctacgggggaaagcgggggaccttcgggcctcgcactattggagcggccgatatcggattagctngttggtggggtaacggcctaccaaggcgacgatccgtagctggtttgagaggacgaccagccacactgggactgagacacggcccagnctcctacgggaggcagcagtggggaattttggacaatgggggcaaccctgatccagccatcccgcgtgtgcgatgaaggccttcgggttgtaaagcacttttggcaggaaagaaacggcacgggctaatatcctgtgcaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagggcttaaccttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcccgaagagatttgggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatngtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcncgggtcttgtacacaccgcncgtcacaccatgggagtgggttttaccagaagtagttagcctaaccgcaaggggggcgattaccacggtagga

SEQ ID NO: 387 - DNA, 1533 bp, Bordetella pertussis
ttgaactgaagagtttgatcctggctcagattgaacgctggcgggatgctttacacatgcaagtcggacggcagcacgggcttcggcctggtggcgagtggcgaacgggtgagtaatgtatcggaacgtgcccagtagcgggggataactacgcgaaagcgtggctaataccgcatacgccctacgggggaaagcgggggaccttcgggcctcgcactattggagcggccgatatcggattagctagttggtggggtaacggcctaccaaggcgacgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcaggaaagaaacggcacgggctaatatcctgtgcaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagggcttaaccttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagtgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcccgaagagatttgggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggttgccaacccgcgagggggagccaatcccagaaacccggtcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctccttt

SEQ ID NO: 388 - DNA, 1533 bp, Borrelia afzelii
gaagagtttgatcctggcttagaactaacgctggcagtgcgtcttaagcatgcaagtcaaacggaatgtagcaatacatttagtggcgaacgggtgagtaacgcgtggatgatctacctatgagatggggataactactagaaatagtagctaataccgaataaggtcaattaatttgttaattgatgaaaggaagcctttaaagcttcgcttgtagatgagtctgcgtcttattagttagttggtggggtaaatgcctaccaagacgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaagcgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggagctatgttggaaactatatgtctagagtctgatagaggaagttagaattcctggtgtaagggtggaatctgttgatatcaggaagaataccggaggcgaaggcgaacttctgggtcaagactgacgctgagtcacgaaagcgtaggtagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatgatggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcacaaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttct

SEQ ID NO: 389 - DNA, 1533 bp, Borrelia burgdorferi
gaagagtttgatcctggcttagaactaacgctggcagtgcgtcttaagcatgcaagtcaaacgggatgtagcaatacattcagtggcgaacgggtgagtaacgcgtggatgatctacctatgagatggggataactattagaaatagtagctaataccgaataaggtcagttaatttgttaattgatgaaaggaagcctttaaagcttcgcttgtagatgagtctgcgtcttattagctagttggtagggtaaatgcctaccaaggcaatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaagtgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggacctatgttggaaactatatgtctagagtctgatagaggaagttagaatttctggtgtaagggtggaatctgttgatatcagaaagaataccggaggcgaaggcgaacttctgggtcaagactgacgctgagtcacgaaagcgtagggagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatggtggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcataaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttct

SEQ ID NO: 390 - DNA, 1299 bp, Borrelia crocidurae
cctggcttagaactaacgctggcagtgcgtcttaagcatgcaagtcagacgagtggcgaacgggtgagtaacgcgtggataatctacctatgagatggggataactattagaaatagtagctaataccgaataaggaaagtcgcttgtagatgagtctgcgtcttattagctagttggtagggtaagagcctaccaaggctatgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggatgacgttaatttatgaataagccccggctaattacgtgccagcagccgcggtaatacgtaaggggcgagcgttgttcgggattattgggcgtaaagggtgagtaggcggatatgcaagtctggcgtaaaataccacagctcaactgtggagctatgctagaaactgcatgactagagtctgataggggaagttagaattcctggtgtaagggtggaatctgttgatatcaggaagaataccagaggcgaaggcgaacttctaggtcaactgacgctgagtcacgaaagcgtagggagcaaacaggattagataccctggtagtctacgctgtaaacgatgcacacttggtgttaatcggttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatacaggtgctgcatggttgtcgtcagctcgtgctgtgaggtgttgggttaagtcccgcaacgagcgcaacccttattgtctgttaccagcatatggggactcagacgagactgccggtgataagccggaggaaggtgaggatgacgtcaaatcatcatggcccttatgtcctgggctacacacgtgctacaatggcctgcaaagcgatgcgaaacagtgatgtgaagcaaaacgcatcaggtctcagtccagatgaagtctgaaactcgacttcagaagttggaatcgctagtaatcgtatatcagaatgatacggtgaatacgttctcgggccttgtacacaccgcccgtcacaccacccgagttgaggatacccgaagctattttctaggaaggtatctaaggtatgtttagtga

SEQ ID NO: 391 - DNA, 1534 bp, Borrelia duttonii
gaagagtttgatcctggcttagaactaacgctggcagtgcgtcttaagcatgcaagtcaaacgggatgtagcaatacattcagtggcgaacgggtgagtaacgcgtggataatctacctatgagatggggataactattagaaatagtagctaataccgaataaggtcagttgagatgtcaattgatgaaaggaagcctttaaagcttcgcttgtagatgagtctgcgtcttattagctagttggtagggtaagagcctaccaaggctatgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggaataagctttgtaggaaatgacaaggtgatgacgttaatttatgaataagccccggctaattacgtgccagcagccgcggtaatacgtaaggggcgagcgttgttcgggattattgggcgtaaagggtgagtaggcggatatgcaagtctgtgcgtaaaataccacagctcaactgtggagctatgctagaaactgcatgactagagtctgataggggaagttagaattcctggtgtaagggtggaatctgttgatatcaggaagaataccagaggcgaaggcgaacttctaggtcaagactgacgctgagtcacgaaagcgtagggagcaaacaggattagataccctggtagtctacgctgtaaacgatgcacacttggtgttaatcgagaggttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatacaggatgtagttagagataactattccccgtttggggtctgtatacaggtgctgcatggttgtcgtcagctcgtgctgtgaggtgttgggttaagtcccgcaacgagcgcaacccttattgtctgttaccagcatgtaaagatggggactcagacgagactgccggtgataagccggaggaaggtgaggatgacgtcaaatcatcatggcccttatgtcctgggctacacacgtgctacaatggcctgtacaaagcgatgcgaaacagtgatgtgaagcaaaacgcataaagcaggtctcagtccagattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgcaagggaggaaggtatctaaggtatgtttagtgaggggggtgaagtcgtaacaaggtagccgtactggaaagtgtggctggatcacctcctttct

SEQ ID NO: 392 - DNA, 1533 bp, Borrelia garinii
gaagagtttgatcctggcttagaactaacgctggcagtgcgtcttaagcatgcaagtcaaacgggatgtagcaatacatctagtggcgaacgggtgagtaacgcgtggatgatctacctacgagatggggataactattagaaatagtagctaataccgaataaagtcaattaatttgttaattgatgaaaggaagcctttaaagcttcgcttgtagatgagtctgcgtcttattagctagttggtagggtaaatgcctaccaaggcgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaagtgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggaactatgttggaaactatatgtctagagtctgatagaggaagttagaatttctggtgtaagggtggaatctgttgatatcagaaagaataccggaggcgaaggcgaacttctgggtcaagactgacgctgagtcacgaaagcgtagggagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatggtggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcataaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttct

SEQ ID NO: 393 - DNA, 1273 bp, Borrelia hermsii
gggtgagtaacgcgtggataatctacctatgagatggggataactattagaaatagtagctaataccgaataaggtcaattgagatgttaattgatgaaaggaagcctttaaagcttcgcttgtagatgagtctgcgtcttattagctagttggtagggtaaaagcctaccaaggctgtgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggaataagctttgtaggaaatgacaaagtgatgacgttaatttatgaataagccccggctaattacgtgccagcagccgcggtaatacgtaaggggcgagcgttgttcgggattattgggcgtaaagggtgagtaggcggatatgcaagtctatgcgtaaaataccacagctcaactgtgggaatatgctggaaactgcatgactagagtctgataggggaagttagaattcctggtgtaagggtggaatctgttgatatcaggaagaataccagaggcgaaggcgaacttctaggtcaagactgacgctgagtcacgaaagcgtagggagcaaacaggattagataccctggtagtctacgctgtaaacgatgcacacttggtgttaatcgaaaggttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatacaggatgtagttagagataactattccccgtttggggtctgtatacaggtgctgcatggttgtcgtcagctcgtgctgtgaggtgttgggttaagtcccgcaacgagcgcaacccttattgtctgttaccagcatgtaaagatggggactcagacgagactgccggtgataagccggaggaaggtgaggatgacgtcaaatcatcatggcccttatgtcctgggctacacacgtgctacaatggcctgtacaaagcgatgcgaaacagtgatgtgaagcaaaacgcataaagcaggtctcagtccagattgaagtctgaaactcgacttcatgaagttggaatcgctagtaatcgtatatcagaatgatacggtgaat

SEQ ID NO: 394 - DNA, 1300 bp, Borrelia hispanica
tcctggcttagaactaacgctggcagtgcgtcttaagcatgcaagtcagacgagtggcgaacgggtgagtaacgcgtggataatctacctatgagatggggataactattagaaatagtagctaataccgaataaggaaagtcgcttgtagatgagtctgcgtcttattagctagttggtagggtaagagcctaccaaggctatgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggatgacgttaatttatgaataagccccggctaattacgtgccagcagccgcggtaatacgtaaggggcgagcgttgttcgggattattgggcgtaaagggtgagtaggcggatatgcaagtctagcgtaaaataccacagctcaactgtggagctatgctagaaactgcatgactagagtctgataggggaagttagaattcctggtgtaagggtggaatctgttgatatcaggaagaataccagaggcgaaggcgaacttctaggtcaactgacgctgagtcacgaaagcgtagggagcaaacaggattagataccctggtagtctacgctgtaaacgatgcacacttggtgttaatcggttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatacaggtgctgcatggttgtcgtcagctcgtgctgtgaggtgttgggttaagtcccgcaacgagcgcaacccttattgtctgttaccagcatatggggactcagacgagactgccggtgataagccggaggaaggtgaggatgacgtcaaatcatcatggcccttatgtcctgggctacacacgtgctacaatggcctgcaaagcgatgcgaaacagtgatgtgaagcaaaacgcatcaggtctcagtccagatgaagtctgaaactcgacttcagaagttggaatcgctagtaatcgtatatcagaatgatacggtgaatacgttctcgggccttgtacacaccgcccgtcacaccacccgagttgaggatacccgaagctattttctaggaaggtatctaaggtatgtttagtga

SEQ ID NO: 395 - DNA, 1526 bp, Borrelia persica
agtttgatcctggcttagaactaacgctggcagtgcgtcttaagcatgcaagtcagacgggatgtagcaatacattcagtggcgaacgggtgagtaacgcgtggataatctacctatgagatggggataactattagaaatagtagctaataccgaataaggtcagttgagatgtcaattgatgaaaggaagcctttaaagcttcgcttgtagatgagtctgcgtcttattagctagttggtggggtaagagcctaccaaggctatgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggaataagctttgtaggaaatgacaaggtgatgacgttaatttatgaataagccccggctaattacgtgccagcagccgcggtaatacgtaaggggcgagcgttgttcgggattattgggcgtaaagggtgagtaggcggatatgcaagtctatgcgtaaaataccacagctcaactgtggagctatgctggaaactgcatgactagagtctgataggggaagttagaattcctggtgtaagggtggaatctgttgatatcaggaagaataccagaggcgaaggcgaacttctaggtcaagactgacgctgagtcacgaaagcgtagggagcaaacaggattagataccctggtagtctacgctgtaaacgatgcacacttggtgttaattgagagattagtaccgaagctaacgtgttaagtgtgccgcctggggagtatgctcgcaagagtgaaactcaaaggaattgacgggggcccgcacaagcggtggagcatgtggtttaattcgatgatacgcgagaaaccttaccagggcttgacatatacaggatgtagttagagataattattccccgtttggggtctgtatacaggtgctgcatggttgtcgtcagctcgtgctgtgaggtgttgggttaagtcccgcaacgagcgcaacccttattgtctgttaccagcatgtaaagatgggaactcagatgagactgccggtgataagccggaggaaggtgaggatgacgtcaaatcatcatggcccttatgccctgggctacacacgtgctacaatggcctgtacaaagcgaagcgaaacagtgatgtgaagcaaaacgcattaaagcaggtctcagtccagattgaagtctgaaactcgacttcatgaagttggaatcgctagtaatcgtatatcagcatgatacggtgaatacgttctcgggccttgtacacaccgcccgtcacaccacccgagttgaggatacccgaagctattattctaacccgcaagggaggaaggtatctaaggtatgtttagtgaggggggtgaagtcgtaacaaggtagccgtactggaaagtgtggctggatcacctcc

SEQ ID NO: 396 - DNA, 1525 bp, Borrelia recurrentis
agtttgatcctggcttagaactaacgctggcagtgcgtcttaagcatgcaagtcaaacgggatgtagcaatacattcagtggcgaacgggtgagtaacgcgtggataatctacctatgagatggggataactattagaaatagtagctaataccgaataaggtcagttgagatgtcaattgatgaaaggaagcctttaaagctttgcttgtagatgagtctgcgtcttattagctagttggtagggtaagagcctaccaaggctatgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggaataagctttgtaggaaatgacaaggtgatgacgttaatttatgaataagtcccggctaattacgtgccagcagccgcggtaatacgtaaggggcgagcgttgttcgggattattgggcgtaaagggtgagtaggcggatatgcaagtctgtgcgtaaaataccacagctcaactgtggagctatgctagaaactgcatgactagagtctgataggggaagttagaattcctggtgtaagggtggaatctgttgatatcaggaagaataccagaggcgaaggcgaacttctaggtcaagactgacgctgagtcacgaaagcgtagggagcaaacaggattagataccctggtagtctacgctgtaaacgatgcacacttggtgttaatcgagaggttagtaccgaagctaacgtgttaagtgtgccgcctggggagtatgctcgcaagagtgaaactcaaaggaattgacgggggcccgtacaagcggtggagcatgtggtttaattcgatgatacgcgaggaaccttaccagggcttgacatatacaggatgtagttagagataactattccccgtttggggtctgtatacaggtgctgcatggttgtcgtcagctcgtgctgtgaggtgttgggttaagtcccgcaacgagcgcaacccttattgtctgttaccagcatgtaaagatggggactcagacgagactgccggtgataagccggaggaaggtgaggatgacgtcaaatcatcatggcccttatgtcctgggctacacacgtgctacaatggcctgtacaaagcgatgcgaaacagtgatgtgaagcaaaacgcataaagcaggtctcagtccagattgaagtctgaaactcgacttcatgaagttggaatcgctagtaatcgtatatcagaatgatacggtgaatacgttctcgggccttgtacacaccgcccgtcacaccacccgagttgaggatacccgaagctattattttaacccgcaagggaggaaggtatctaaggtatgtttagtgaggggggtgaagtcgtaacaaggtagccgtactggaaagtgtggctggatcacctcc

SEQ ID NO: 397 - DNA, 1467 bp, Borrelia sp.
  NE49
ctggcttagaactaacgctggcagtgcgtcttaagcatgcaagtcaaacggaatgtagcaatacattcagtggcgaacgggtgagtaacgcgtggatgatctgcctatgagatggggataactattagaaatagtagctaataccgaataaggtcaattaatttgttaattgatgaaaggaagcctttaaagcttcgcttgtagatgagtctgcgtcttattagctagttggtagggtaaatgcctaccaaggcgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaagtgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggacctatgttggaaactatatgtctagagtctgatagaggaagttagaatttctggtgtaagggtggaatctgttgatatcagaaagaataccggaggcgaaggcgaacttctgggtcaagactgacgctgagtcacgaaagcgtagggagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatggtggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcataaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtg

SEQ ID NO: 398 - DNA, 1531 bp, Borrelia spielmanii
agagtttgatcctggcttagaactaacgctggcagtgcgtcttaagcatgcaagtcaaacgggatgtagcaatacatctagtggcgaacgggtgagtaacgcgtggatgatctacctatgagatggggataactactagaaatagtagctaataccgaataaggtcaattaatttgttaattgatgaaaggaagcctttaaagcttcgcttgtagatgagtctgcgtcttattagttagttggtggggtaaatgcctaccaaggcgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaggtgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggaactatgttggaaactatatgtctagagtctgatagaggaagttagaattcctggtgtaagggtggaatctgttgatatcaggaagaataccggaggcgaaggcgaacttctgggtcaagactgacgctgagtcacgaaagcgtagggagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggcctatatacaggtgctgcatggttgtcgtcagctcgtgctgtgaggtgttgggttaagtcccgcaacgagcgcaacccttgttatctgttaccagcatgtaatgatggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcacaaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttct

SEQ ID NO: 399 - DNA, 1532 bp, Borrelia turicatae
agagtttgatcctggcttagaactaacgctggcagtgcgtcttaagcatgcaagtcagacggaatgtagcaatacattcagtggcgaacgggtgagtaacgcgtggataatctacctatgagatggggataactattagaaatagtagctaataccgaataaggtcaattgagatgttaattgatgaaaggaagcctttaaagcttcgcttgtagatgagtctgcgtcttattagctagttggtagggtaagagcctaccaaggctatgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggaataagctttgtaggaaatgacaaggtgatgacgttaatttatgaataagccccggctaattacgtgccagcagccgcggtaatacgtaaggggcgagcgttgttcgggattattgggcgtaaagggtgagtaggcggatatgtaagtctatgcgtaaaataccacagctcaactgtggaactatgctggaaactgcatgactagagtctgataggggaagttagaattcctggtgtaagggtggaatctgttgatatcaggaagaataccagaggcgaaggcgaacttctaggtcaagactgacgctgagtcacgaaagcgtagggagcgaacaggattagataccctggtagtctacgctgtaaacgatgcacacttggtgttaatcgaaaggttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatacaggatgtagttagagataactattccccgtttggggtctgtatacaggtgctgcatggttgtcgtcagctcgtgctgtgaggtgttgggttaagtcccgcaacgagcgcaacccttattgtctgttaccagcatgtaaagatggggactcagacgagactgccggtgataagccggaggaaggtggggatgacgtcaaatcatcatggcccttatgtcctgggctacacacgtgctacaatggcctgtacaaagcgatgcgaaacagtgatgtgaagcaaaacgcataaagcaggtctcagtccagattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgcaagggaggaaggtatctaaggtatgtttagtgaggggggtgaagtcgtaacaaggtagccgtactggaaagtgtggctggatcacctcctttct

SEQ ID NO: 400 - DNA, 1533 bp, Borrelia valaisiana
gaagagtttgatcctggcttagaactaacgctggcagtgcgtcttaagcatgcaagtcaaacgggatgtagtaatacatctagtggcgaacgggtgagtaacgcgtggatgatctacctatgagatggggataactactagaaatagtagctaataccgaataaggtcaattaatttgttaattgatgaaaggaagcctttaaagcttcgcttgtagatgagtctgcgtcttattagttagttggtggggtaaatgcctaccaaggcgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaagtgatgacgttaatttatgaataagccccggctaattacgtgccagcagccgcggtaatacgtaaggggcgagcgttgttcgggattattgggcgtaaagggtgagtaggcggacatataagtctatgcataaaataccacagctcaactgtggaactatgttggaaactatatgcctagagtctgatagaggaagttagaattcctggtgtaagggtggaatctgttgatatcaggaagaataccggaggcgaaggcgaacttctgggtcaagactgacgctgagtcacgaaagcgtagggagcaaacaggattagataccctggtagtctacgctgtaaacgatgcacacttggtgttaactgaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatgatggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcataaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttct

SEQ ID NO: 401 - DNA, 1512 bp, Brachybacterium alimentarium
  modified_base (11)..(12): a, c, t, g, unknown or other
agagtttgatnntggctcaggacgaacgctggcggcgtgcttaacacatgcaagtcgaacgatgacgaccgagcttgctcggtctgattagtggcgaacgggtgagtaacacgtgagtaacctgccccccacttcgggataacttcgagaaatcgtggctaataccggatatgaacttccgccgcatggtggttgttggaaagtttttcggtgggggatggactcgcggcctatcagtttgttggtgaggtaatggctcaccaagacgatgacgggtagccggcctgagagggcgaccggccacactgggactgagacacggcccagactcctacgggaggcagcagtggggaatattgcacaatgggcgaaagcctgatgcagcgacgccgcgtgagggatgacggcctttgggttgtaaacctctttcagtagggaagaagcgagagtgacggtacctgcagaagaagcgccggctaactacgtgccagcagccgcggtaatacgtagggcgcaagcgttgtccggaattattgggcgtaaagagcttgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgagaagcgaaagcatgggtagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgctgattaattcgatgcaacgcgaagaaccttaccaaggcttgacatggaccggacggctgcaaaaatgtggctttcttcggactggttcacaggtggtgcatggttgtcgtcagctcgtgtcgtgagatgttgggttaagtcccgcaacgagcgcaaccctcgttctatgttgccagcgcgttatggcggggactcatgggagactgccggggtcaactcggaggaaggtggggacgacgtcaaatcatcatgccccttatgtcttgggcttcaagcatgctacaatggtcggtacaatgggttgcgaaactgtgaggtggagcgaatcctaaaaagccggcctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccagtggcccatcctcgtgagggagctgtcgaaggtgggatcggtgattgggactaagtcgtaacaaggtagccgtaccggaaggtgcggctggatcacctccttt

SEQ ID NO: 402 - DNA, 1458 bp, Brachybacterium conglomeratum
tggctcaggacgaacgctggcggcgtgcttaacacatgcaagtcgaacgatgacggtggtgcttgcaccgcctgattagtggcgaacgggtgagtaacacgtgagtaacctgccctccacttcgggataacctcgggaaatcgtggctaataccggatatgagcactcatcgcatggtgggtgttggaaagatttatcggtgggggatggactcgcggcctatcagtttgttggtgaggtgatggctcaccaagacgatgacgggtagccggcctgagagggcgaccggccacactgggactgagacacggcccagactcctacgggaggcagcagtggggaatattgcacaatgggcgaaagcctgatgcagcgacgccgcgtgggggatgacggccttcgggttgtaaacccctttcagtagggaagaagcgagagtgacggtacctgcagaagaagcgccggctaactacgtgccagcagccgcggtaatacgtagggcgcaagcgttgtccggaattattgggcgtaaagagcttgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgagaagcgaaagcatgggtagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgctgattaattcgatgcaacgcgaagaaccttaccaaggcttgacatgcactggacggctgcagagatgtggctttctttggactggtgcacaggtggtgcatggttgtcgtcagctcgtgtcgtgagatgttgggttaagtcccgcaacgagcgcaaccctcgttctatgttgccagcacgtaatggtggggactcataggagactgccggggtcaactcggaggaaggtggggacgacgtcaaatcatcatgccccttatgtcttgggcttcaagcatgctacaatggtcggtacaatgggttgcgaaactgtgaggtggagcgaatcccaaaaagccggcctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccagtggcccatcctcgtgagggagctgtctaaggtgggatcggtgattgggactaagtcgta

SEQ ID NO: 403 - DNA, 1512 bp, Brachybacterium tyrofermentans
  modified_base (11)..(12): a, c, t, g, unknown or other
agagtttgatnntggctcaggatgaacgctggctgcgtgcttaacacatgcaagtcgaacgatgacgaccgagcttgctcggtctgattagtggcgaacgggtgagtaacacgtgagtaacctgcccctcacttcgggataacctcgagaaattgtggctaataccggatatgaacttccgccgcatggtggttgttggaaagtttttcggtgagggatggactcgcggcctatcagtttgttggtgaggtaatggctcaccaagacgatgacgggtagccggcctgagagggcgaccggccacactgggactgagacacggcccagactcctacgggaggcagcagtggggaatattgcacaatgggcgaaagcctgatgcagcgacgcagcgtgggggatgactgccttcgggttgtaaacctctttcagtagggaagaagcgaaagtgacggtacctgcagaagaagcgccggctaactacgtgccagcagccgcggtaatacgtagggcgcaagcgttatccgtaattattgggcgtaaagagcttgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgagaagcgaaagcatgggtagcgaacaggattagataccctggtagtccatgccgtaaacgttgggcactagatgtgggggacattccacgttttccgcgtcgtagctaacgcattaagtgccccgcctggggagtacggccgcaaggctaaaactcaaaggaattgacgggggcccgcacaagcggcggagcatgctgattaattcgatgcaacgcgaagaaccttaccaaggcttgacatggaccggacggctgcagaaatgtggctttcttcggactggttcacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggacgacgtcaaatcatcatgccccttatgtcttgggcttcaagcatgctacaatggtcggtacaatgggttgcgaaactgtgaggtggagcgaatcccaaaaagccggcctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccagtggcccatcctcgtgagggagctgtctaaggtgggattggtgattgggactaagtcgtaacaaggtagccgtaccggaaggtgcggctggatcacctccttt

SEQ ID NO: 404 - DNA, 1270 bp, Brachyspira aalborgi
agcgaacgttggcgatgcgtcttaagcatgcaagtcgagcgagcggcgaactggtgagtaacacgtaggtaatctgccgtagagtgggggataacccatggaaacatggactaataccgcatatagaaagccgctttacgatgagcctgcggcctattagcctgttggtgagataaaagcccaccaaagctacgataggtagccgacctgagagggtgaccggccacattgggactgagatacggcccagactcctacgggaggcagcagctgagaatcttccacaatggacgaaagtctgatggagcgacatcgcgtgagggatgaaggccttcgggttgtaaaccttggaaattatcgaagatgacagtagataatgtaagcctcggctaactacgtgccagcagccgcggtaatacgtaggaggcaaacgttgctcggatttactgggcgtaaagggtgagtaggcggaactataagtctaaggtgaaatatcgaagctcaacttcggagacgcctcggatactgtggttcttggatattgtaggggatgatggaattctcggtgtagcggtggaatgtatagatatcgagaagaacacctatagcgaaggcagtcatctgggcatatcgacgctgaatcacgaaagctgggggagcaaacaggcttagataccctggtagtcccagccgtaaacgttgcacactaggtgctcctaggcgtgccgtagctaacgtcttaagtgtgccgcctgaggagtatgcccgcaagggtgaaactcaaagaaattgacgggtccccgcacaagtggtggagcatgtggtttaattcgatgatacgcgaaaaaccttacctgggtttgaattgcataggtgctgcatggctgtcgtcagctcgtgtcgtgagatgttgggttaagtcccgcaacgagcgcaacccttaccctttgttgctaccgatcgggcactcttaggggaccgcctacgttaagtaggaggaaggtggggatgatgtcaagtcctcatggcccttatgtccagggctacacacgtgctacaatggcaaccaaagagaagcgagaccgcgaggtggagcaaatctcaagttgcctcagttcggatggagtctgaaactcgactccagaagttggaatcactagtaatcgtagatcagaacgctacggtgaatacgttcccggggattgtacacaccgcccgtcacgccatcggagttggttttacctgaagtcgttgcctagggcggcgccga

SEQ ID NO: 405 - DNA, 1506 bp, Brachyspira pilosicoli
agagtttgattctggctcagagcgaacgttggcgatgcgtcttaagcatgcaagtcgagcgggcttattcgggcaactggataagttagcggcgaactggtgagtaacacgtaggtaatctgccgtgaagcgggggataacccatggaaacatggactaataccgcatatactcttgctacataagtagagtagaggaaagttttttcgcttcacgatgagcctgcggcctattagcctgttggtagggtaatggcctaccaaagctacgataggtagccgacctgagagggtgaccggccacattgggactgagatacggcccagactcctacgggaggcagcagctgagaatcttccacaatggacgaaagtctgatggagcgacatcgcgtgagggatgaaggccttcgggttgtaaacctcggaaattatcgaagaatgagtgacagtagataatgtaagcctcggctaactacgtgccagcagccgcggtaatacgtaggaggcaaacgttgctcggatttactgggcgtaaagggtgagtaggcggatttataagtctaaggtgaaagaccgaagctcaacttcgggaacgcctcggatactgtaagtcttggatattgtaggggatgatggaattctcggtgtagcggtggaatgcgcagatatcgagaggaacacctatagcgaaggcagtcatctgggcatttatcgacgctgaatcacgaaagctaggggagcaaacaggcttagataccctggtagtcctagccgtaaacgttgtacactaggtgcttctatttaaataggagtgccgtagctaacgtcttaagtgtaccgcctgaggagtatgcccgcaagggtgaaactcaaagaaattgacgggtccccgcacaagtggtggagcatgtggtttaattcgatgatacgcgaaaaaccttacctgggtttgaattgttagatgaatgatttagagataagtcagaccgcaaggacgtttaacataggtgctgcatggctgtcgtcagctcgtgtcgtgagatgttgggttaagtcccgcaacgagcgcaaccctcaccctctgttgctaccgagtaatgtcgagcactcttaggggactgcctacgttcaagtaggaggaaggtggggatgatgtcaagtcctcatggcccttatgtccagggctacacacgtgctacaatggcaagtacaaagagaagcaagaccgcgaggtggagcaaaactcaaaaaagttgcctcagttcggattggagtctgaaactcgactccatgaagttggaatcactagtaatcgtagatcagaacgctacggtgaatacgttcccggggattgtacacaccgcccgtcacgccatcggagttggttttacctgaagccgttagcctaaccgcaaggagggcggcgtcgaaggtgggactgatgatgagggtgaagtcgtaacaaggcagccgtaccggaaggtgtggctggatcacctccttt

SEQ ID NO: 406 - DNA, 1272 bp, Brachyspira sp.
  HIS3
agcgaacgttggcgatgcgtcttaagcatgcaagtcgagcgagcggcgaactggtgagtaacacgtaggtaatctgccgtgaagtgggggataacccatggaaacatggactaataccgcatatagaaagtcgcttcacgatgagcctgcggcctattagcctgttggtagggtaatggcctaccaaagctacgataggtagccgacctgagagggtgaccggccacattgggactgagatacggcccagactcmtacgggaggcagcagctgagaatcttccacaatggacgaaagtctgatggagcgacatcgcgtgagggatgaaggccttcgggttgtaaacctcggaaattatcgaagatgacagtagataatgtaagcctcggctaactacgtgccagcagccgcggtaatacgtaggaggcaaacgttgctcggatttactgggcgtaaagggtgagtaggcggatttataagtctaaggtgaaagaccgaagctcaacttcgggaacgcctcggatactgtagatcttggatattgtaggggatgatggaattctcggtgtagcggtggaatgcgcagatatcgagaggaacacctatagcgaaggcagtcatctgggcatatcgacgctgaatcacgaaagctaggggagcaaacaggcttagataccctggtagtcctagccgtaaacgttgtacactaggtgcttctataggagtgccgtagctaacgtcttaagtgtaccgcctgaggagtatgcccgcaagggtgaaactcaaagaaattgacgggtccccgcacaagtggtggagcatgtggtttaattcgatgatacgcgaaaaaccttacctgggtttgaattgcataggtgctgcatgcctgtcgtcagctcgtgtcgtgagatgttgggttaagtcccgcaacgagcgcaaccctcaccctctgttgctaccgatcgagtactcttaggggactgcctacgtcaagtaggaggaaggtggggatgatgtcaagtcctcatggcccttatgtccagggctacacacgtgctacaatggcaagcaaagagaagcaagaccgcgaggtggagcaaaactcaagttgcctcagttcggatggagtctgaaactcgactccagaagttggaatcactagtaatcgtagatcagaacgctacggtgaatacgttcccggggattgtacacaccgcccgtcacgccatcggagttggttttacctgaagccgttgcctagggcggcgtcga

SEQ ID NO: 407 - DNA, 1325 bp, Brachyspira sp.
  HIS4
agcgaacgttggcgatgcgtcttaagcatgcaagtcgagcgagcggcgaactggtgagtaacacgtaggtaatctgccgtgaagtgggggataacccatggaaacatggactaataccgtatatagaaagtcgcttcacgatgagcctgcggcctattagcctgttggtagggtaatggcctaccaaagctacgataggtagccgacctgagagggtgaccggccacattgggactgagatacggcccagactcctacgggaggcagcagctgagaatcttccacaatggacgaaagtctgatggagcgacatcgcgtgagggatgaaggccttcgggttgtaaacctcggaaattatcgaagatgacagtagataatgtaagcctcggctaactacgtgccagcagccgcggtaatacgtaggaggcaaacgttgctcggatttactgggcgtaaagggtgagtaggcggatttataagtctaaggtgaaagaccgaagctcaacttcgggaacgcctcggatactgtagatcttggatattgcaggggatgatggaattctcggtgtagcggtggaatgcgcagatatcgagaggaacacctatagcgaaggcagtcatctgggcatatcgacgctgaatcacgaaagctaggggagcaaacaggcttagataccctggtagtcctagccgtaaacgttgtacactaggtgcttctataggagtgccgtagctaacgtcttaagtgtaccgcctgaggagtatgcccgcaagggtgaaactcaaagaaattgacgggtccccgcacaagtggtggagcatgtggtttaattcgatgatacgcgaaaaaccttacctgggtttgaattgcataggtgctgcatgcctgtcgtcagctcgtgtcgtgagatgttgggttaagtcccgcaacgagcgcaaccctcaccctctgttgctaccgatcgagtactcttaggggactgcctacgtcaagtaggaggaaggtggggatgatgtcaagtcctcatggcccttatgtccagggctacacacgtgctacaatggcaagcaaagagaagcaagaccgcgaggtggagcaaaactcaagttgcctcagttcggatggagtctgaaactcgactccagaagttggaatcactagtaatcgtagatcagaacgctacggtgaatacgttcccggggattgtacacaccgcccgtcacgccatcggagttggttttacctgaagccgttgcctagggcggcgtcgaaggtgggactgatgatgagggtgaagtcgtaacaaggcagccgtaccggaagg

SEQ ID NO: 408 - DNA, 1278 bp, Brachyspira sp.
  HIS5
gaacgttggcgatgcgtcttaagcatgcaagtcgagcgagcggcgaactggtgagtaacacgtaggtaatctgccgtgaagtgggggataacccatggaaacatggactaataccgcatatagaaagtcgcttcacgatgagcctgcggcctattagcctgttggtagggtaatggcctaccaaagctacgataggtagccgacctgagagggtgaccggccacattgggactgagatacggcccagactcctacgggaggcagcagctgagaatcttccacaatggacgaaagtctgatggagcgacatcgcgtgagggatgaaggccttcgggttgtaaacctcggaaattatcgaagatgacagtagataatgtaagcctcggctaactacgtgccagcagccgcggtaatacgtaggaggcaaacgttgctcggatttactgggcgtaaagggtgagtaggcggatttataagtctaaggtgaaagaccgaagctcaacttcgggaacgcctcggatactgtagatcttggatattgtaggggatgatggaattctcggtgtagcggtggaatgcgcagatatcgagaggaacacctatagcgaaggcagtcatctgggcatatcgacgctgaatcacgaaagctaggggagcaaacaggcttagataccctggtagtcctagccgtaaacgttgtacactaggtgcttctataggagtgccgtagctaacgtcttaagtgtaccgcctgaggagtatgcccgcaagggtgaaactcaaagaaattgacgggtccccgcacaagtggtggagcatgtggtttaattcgatgatacgcgaaaaaccttacctgggtttgaattgcataggtgctgcatgcctgtcgtcagctcgtgtcgtgagatgttgggttaagtcccgcaacgagcgcaaccctcaccctctgttgctaccgatcgagtactcttaggggactgcctacgtcaagtaggaggaaggtggggatgatgtcaagtcctcatggcccttatgtccagggctacacacgtgctacaatggcaagcaaagagaagcaagaccgcgaggtggagcaaaactcaagttgcctcagttcggatggagtctgaaactcgactccagaagttggaatcactagtaatcgtagatcagaacgctacggtgaatacgttcccggggattgtacacaccgcccgtcacgccatcggagttggttttacctgaagccgttgcctagggcggcgtcgaaggtgggac

SEQ ID NO: 409 - DNA, 1029 bp, Brevibacillus agri
  modified_base (9)..(9): a, c, t, g, unknown or other
  modified_base (11)..(11): a, c, t, g, unknown or other
  modified_base (22)..(22): a, c, t, g, unknown or other
  modified_base (58)..(60): a, c, t, g, unknown or other
  modified_base (70)..(70): a, c, t, g, unknown or other
aaagttctntntcagagacgancaagtaccgttcgaacagggcggtaccttgacggtnnngacgagaaanccacggctaactacgtgccagcagccgcggtaatacgtaggtggcaagcgttgtccggaattattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgtcctagagatagggcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggctggtacaacgggaagctagctcgcgagagtatgccaatctcttaaaaccagtctcagttcggattgcaggctgcaactcgcctgcatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagcca

SEQ ID NO: 410 - DNA, 1461 bp, Brevibacillus brevis
  modified_base (44)..(45): a, c, t, g, unknown or other
  modified_base (54)..(55): a, c, t, g, unknown or other
gacgaacgctggcggcgtgcctaatacatgcaagtcgagcgagnntcttcggannctagcggcggacgggtgagtaacacgtaggcaacctgcctctcagactgggataacatagggaaacttatgctaataccggataggtttttggatcgcatgatccgaaaagaaaaggcggcttcggctgtcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaataagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaag

SEQ ID NO: 411 - DNA, 1419 bp, Brevibacillus centrosporus
  modified_base (23)..(23): a, c, t, g, unknown or other
  modified_base (27)..(27): a, c, t, g, unknown or other
  modified_base (156)..(156): a, c, t, g, unknown or other
  modified_base (162)..(162): a, c, t, g, unknown or other
  modified_base (180)..(181): a, c, t, g, unknown or other
  modified_base (198)..(198): a, c, t, g, unknown or other
  modified_base (200)..(200): a, c, t, g, unknown or other
  modified_base (212)..(212): a, c, t, g, unknown or other
  modified_base (321)..(321): a, c, t, g, unknown or other
  modified_base (411)..(411): a, c, t, g, unknown or other
  modified_base (450)..(450): a, c, t, g, unknown or other
  modified_base (478)..(478): a, c, t, g, unknown or other
  modified_base (644)..(644): a, c, t, g, unknown or other
  modified_base (717)..(717): a, c, t, g, unknown or other
  modified_base (870)..(870): a, c, t, g, unknown or other
  modified_base (1403)..(1403): a, c, t, g, unknown or other
gagagtttgatcctggctcaggncgancgctggcggcgtgcctaatacatgcaagtcgagcgagtctcttcggaggctagcggcggacgggtgagtaacacgtaggcaacctgcctctcagactgggataacatagggaaacttatgctaataccngatagngtcttgtctcgcatgagnnaagacggaaaggtagcncnggctatcacttncggatgggcctgcggcgcattagctagttggtggggtaatggcctaccaaggcgacgatgcgtagccgacctgagagggtgaccggccacactgggactgagacacggnccagactcctacgggaggcagcagtagggaattttccacaatggacgaaagtctgatggagcaacgccgcgtgaacgatgaaggtcttcngattgtaaagttctgttgttagggacgaacaagtaccgntcgaatagggcggtaccttgacggtacntgacgagaaagccacggctaactacgtgccagcagccgcggtaatacgtaggtggcaagcgttgtccggatttattgggcgtaaagcgcgcgcaggcggctatgtaagtctggtgttaaagcccggagctcaactccggttcgcatcggaaactgtgtagcttgantgcagaagaggaaagcggtattccacgtgtagcggtgaaatgcgtagagatgtggaggaacaacagtggcganggcggctttctggtctgtaactgacgctgaggcgcgaaagcgtggggagcaaacaggattagataccctggtagtccacgccgcaaacgatgagtgctaggtgttgggggtttcaataccctcagtgccgcagctaacgcaataagcactccncctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatttctagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacnggagtttgcaacaccc

SEQ ID NO: 412 - DNA, 1486 bp, Brevibacillus choshinensis
  modified_base (44)..(44): a, c, t, g, unknown or other
  modified_base (51)..(51): a, c, t, g, unknown or other
cgaacgctggcggcgtgcctaatacatgcaagtcgagcgagtcncttcggnggctagcggcggacgggtgagtaacacgtaggcaacctgcctctcagactgggataacatagggaaacttatgctaataccggataggtttttggatcgcatgatccgaaaagaaaaggcggcttcggctgtcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaacaagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggagctcaactccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatttctagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgaggggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaagg

SEQ ID NO: 413 - DNA, 1391 bp, Brevibacillus invocatus
tcgagcgagtcccttcgggggctagcggcggacgggtgagtaacacgtaggcaacctgcccgtaagctcgggataacatggggaaactcatgctaataccggatagggtcttctctcgcatgagaggagacggaaaggtggcgcaagctaccacttacggatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagagacaacaagtaccgttcgaacagggcggtaccttgcggtacctgacgagaaagccacggctaactacgtgccagcagccgcggtaatacgtaggtggcaagcgttgtccggaattattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgtcctacatatagggcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggctggtacaacgggaagctagctcgcgagagtatgccaatctcttaaaaccagtctcagttcggattgcaggctgcaactcgcctgcatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagcca

SEQ ID NO: 414 - DNA, 1470 bp, Brevibacillus laterosporus
  modified_base (231)..(231): a, c, t, g, unknown or other
gacgaacgctggcggcgtgcctaatacatgcaagtcgagcgagggtcttcggaccctagcggcggacgggtgagtaacacgtaggcaacctgcctgtaagactgggataacatagggaaacttatgctaataccggatagggttttgcttcgcctgaagcgaaacggaaagatggcgcaagctatcacttacagatgggcctgcggcgcattagctagttggtgaggtaanggctcaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggctttcgggtcgtaaagttctgttgttagggaagaaacagtgctatttaaataaggtagcaccttgacggtacctaaccagaaagccacggctaactacgtgccagcagccgcggtaatacgtaggtggcaagcgttgtccggaattattgggcgtaaagcgcgcgcaggtggctatgtaagtctgatgttaaagcccgaggctcaacctcggttcgcattggaaactgtgtagcttgagtgcaggagaggaaagtggtattccacgtgtagcggtgaaatgcgtagagatgtggaggaacaccagtggcgaaggcgactttctggcctgtaactgacactgaggcgcgaaagcgtggggagcaaacaggattagataccctggtagtccacgccgtaaacgatgagtgctaggtgttaggggtttcaatacccttagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccactgaccgctctagagatagagcttcccttcggggcagtggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacttcgcgagaagatgctaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgtaaggagccagccgccgaaggtggggtagataactggggtgaagtcgtaacaa

SEQ ID NO: 415 - DNA, 1486 bp, Brevibacillus parabrevis
cgaacgctggcggcgtgcctaatacatgcaagtcgagcgagggttttcggaccctagcggcggacgggtgagtaacacgtaggcaacctgcctctcagaccgggataacatagggaaacttatgctaataccggataggtttttggattgcatgatccgaaaagaaaagatggcttcggctatcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagggacgaacacgtgccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggagctcaactccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctctgaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaagg

SEQ ID NO: 416 - DNA, 1486 bp, Brevibacillus reuszeri
  modified_base (994)..(994): a, c, t, g, unknown or other
cgaacgctggcggcgtgcctaatacatgcaagtcgagcgagtctcttcggaggctagcggcggacgggtgagtaacacgtaggcaacctgcctctcagactgggataacatagggaaacttatgctaataccggataggtttttggaccgcatggtccgaaaagaaaagatggcttcggctatcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaataagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggagctcaactccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttccnttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggacgctagcccgcgagggtatgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaagg

SEQ ID NO: 417 - DNA, 1477 bp, Brevibacillus sp.
  phR
gatcctggctcaggacgaacgctggcggcgtgcctaatacatgcaagtcgagcgaaggacttcggtccttagcggcggacgggtgagtaacacgtaggcaacctgcccgtcagacygggataacatagggaaacttatgctaataccagataggtttctsgactgcatggtaggaraaggaaagayggcgcaagctgtcacttggggatgggcctgcggcgcattagctggttggcggggtaacggcccaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggccttcgggttgtaaagttctgttgtcagggacgaacaagtacctgttcgaacagggcggtaccttgacggtacctgacgagaaagccacggctaactacgtgccagcagccgcggtaatacgtaggtggcaagcgttgtccggaattattgggcgtaaagcgcgcgcaggcggctatgtaagtctgatgttaaagcccggggctcaactccggttcgcattggaaactgcgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcgataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgtcctggagacagggcttcccttcggggcagcggtgacaggtggtgcatggttgtcgtcagctcgtgtcgtgagatgttgggttaagtcccgcaacgagcgcaacccttatctttagttgccagcattcggttgggcactctagagagactgccgtcgacaagacggaggaaggcggggatgacgtcaaatcatcatgccccttatgacctgggctacacacgtgctacaatggctggtacaacgggacgcgagcccgcgagggttagccaatctctgaaaaccagtctcagttcggattgcaggctgcaactcgcctgcatgaagtcggaatcgctagtaatcgcggatcagcatgccgcggtgaatacgttcccgggccttgtacacaccgcccgtcacaccacgagagtttgcaacacccgaagtcggtgaggtaaccgcaaggagccagccgccgaaggtggggtagatgattggggtgaagtc

SEQ ID NO: 418 - DNA, 1385 bp, Brevibacillus thermoruber
  modified_base (1374)..(1374): a, c, t, g, unknown or other
tttgaagcttgcttcagacaggttagcggcggacgggtgagtaacacgtaggcaacctgcccgcaagaccgggataacgtagggaaacttacgctaataccggatagggcaccttctcgcatgagagggtgcggaaaggtggcgcaagctaccacttgcggatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatgggcgaaagcctgatggagcaacgccgcgtgaacgatgaaggtcttcggattgtaaagttctgttgtcagggacgaacaagtaccgttcgaacagggcggtaccttgacggtacctgacgagaaagccccggctaactacgtgccagcagccgcggtaatacgtagggggcaagcgttgtccggaattattgggcgtaaagcgcgcgcaggcggtcgggtaagtctgatgtcaaagcccggggctcaaccccggtacgcattggaaactgctcgacttgagtgcagaagaggaaagcggaattccacgtgtagcggtgaaatgcgtagagatgtggaggaacaccagtggcgaaggcggctttctggtctgtaactgcgctgaggcgcgaaagcgtggggagcaaacaggattagataccctggtagtccacgccgtaaacgatgagtgtaggtgttgggggtttcaatcctcagtgccgcagtaacgcaataagcactccgcctggggagtacgctcgcaagagtgaaactcaaaggaattgacgggggcccgcacaagcggtggagcatgtggtttaattcgaagcaacgcgaagaaccttaccggtcttgacatcccgctgaccgcctagagatagggcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgttacaatggttggtacaacgggacgcaagcccgcgagggtaagccaatctcttaaaaccagtctcagttcggattgcaggctgcaactcgcctgcatgaagtcggaatcgctagtaatcgcggatcagcatgccgcggtgaatacgttcccgggccttgtacacaccgcccgtcacaccacgagagtttgcaacacccgaagtcggtgaggtanccgcaaggagc

SEQ ID NO: 419 - DNA, 1474 bp, Brevibacterium aurantiacum
  modified_base (10)..(10): a, c, t, g, unknown or other
  modified_base (35)..(35): a, c, t, g, unknown or other
  modified_base (418)..(419): a, c, t, g, unknown or other
  modified_base (421)..(421): a, c, t, g, unknown or other
ctgcgtgctnaacacatgcaagtcgaacgctgaanccctggtgcttgcacggggtggatgagtggcgaacgggtgagtaacacgtgagtaacctgcccccgacttcgggataagcccgggaaactgggtctaataccggatatgaccatcactcgcatgagtgatggtggaaagttttttcggttggggatgggctcgcggcctatcagtttgttggtgaggtaatggctcaccaagacgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagaagccnntnggggtgacggtacctgcagaagaagtaccggctaactacgtgccagcagccgcggtaatacgtagggtacaagcgttgtccggaattattgggcgtaaagagctcgtaggtggttggtcacgtctgctgtggaaacgcaacgcttaacgttgcgcgtgcagtgggtacgggctgactagagtgcagtaggggagtctggaattcctggtgtagcggtgaaatgcgcagatatcaggaggaacaccggtggcgaaggcgggactctgggctgtaactgacactgaggagcgaaagcatggggagcgaacaggattagataccctggtagtccatgccgtaaacgttgggcactaggtgtgggggacattccacgttctccgcgccgtacgtaacgcattaagtgccccgcctggggagtacggtcgcaaggctaaaactcaaaggaattgacgggggccgcacaagcggcggagcatgcggattaattcgatgcaacgcgaagaaccttaccaaggcttgacatacaccagaccgttctggaaacagttcctccctttggggttggtgtacaggtggtgcatggttgtcgtcagctcgtgtcgtgagatgttgggttaagtcccgcaacgagcgcaaccctcgttctatgttgccagcacgtgatggtgggaactcataggagactgccggggtcaactcggaggaaggtggggatgacgtcaaatcatcatgccctttatgtcttgggcttcacgcatgctacaatggctggtacagagagatgcgagaccgcgaggttttagcgaatcccttaaagccagtctcagttcggatcgtagtctgcaattcgactacgtgaagtcggagtcgctagtaatcgcagatcagcaacgctgcggtgaatacgttcccgggccttgtacacaccgcccgtcaagtcacgaaagtcggtaacacccgaagccggtggcccaacccttgtggagggggccgtctaaggtgggactggtgattgggactaagtcgtaacaaggtagccgtaccggaaggtgc

SEQ ID NO: 420 - DNA, 1389 bp, Brevibacterium casei
tgcagtcgtacgctgaagcctgtagcttgcaccgggtggatgagtggcgaacgggtgagtaacacgtgagtaacctgcccctgacttcgggataagcccgggaaactgggtctaataccggatacgactgccggacgcatgtctggtggtggaaagttttttcggttggggatgggctcgcggcctatcagtttgttggtgaggtaatggctcaccaagacgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagaagcgcaagtgacggtacctgcagaagaagtaccggctaactacgtgccagcagccgcggtaatacgtagggtacgagcgttgtccggaattattgggcgtaaagagctcgtaggtggttggtcacgtctgctgtggaaacgcaacgcttaacgttgcgcgtgcagtgggtacgggctgactagagtgcagtaggggagtctggaattcctggtgtagcggtgaaatgcgcagatatcaggaggaacaccggtggcgaaggcgggactctgggctgtaactgacactgaggagcgaaagcatggggagcgaacaggattagataccctggtagtccatgccgtaaacgttgggcactaggtgtggggggcattccacgttctccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgacatacaccggaccgtcctggaaacaggtcctcttctttgaagctggtgtacaggtggtgcatggttgtcgtcagctcgtgtcgtgagatgttgggttaagtcccgcaacgagcgcaaccctcgttctatgttgccagcacgtgatggtgggaactcataggagactgccggggtcaactcggaggaaggtggggatgacgtcaaatcatcatgccctttatgtcttgggcttcacgcatgctacaatggctggtacagagagaggcgaacccgtgagggcaagcgaatcccttaaagccagtctcagttcggatcgtagtctgcaattcgactacgtgaagtcggagtcgctagtaatcgcagatcagcaacgctgcggtgaatacgttcccgggccttgtacacaccgcccgtcaagtcacgaaagtcggtaacacccgaagccggtggcctaaccgtaaggaggggg

SEQ ID NO: 421 - DNA, 1480 bp, Brevibacterium epidermidis
  modified_base (162)..(162): a, c, t, g, unknown or other
ctgcgtgcttaacacatgcaagtcgaacgctgaagccgacagcttgctgttggtggatgagtggcgaacgggtgagtaacacgtgagtaacctgcccctgatttcgggataagcctgggaaactgggtctaataccggatacgaccacctgacgcatgttgngtggtggaaagtttttcgatcggggatgggctcgcggcctatcagcttgttggtggggtaatggcctaccaaggcgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagaagcgaaagtgacggtacctgcagaagaagtaccggctaactacgtgccagcagccgcggtaatacgtagggtacgagcgttgtccggaattattgggcgtaaagagctcgtaggtggttggtcacgtctgctgtggaaacgcaacgcttaacgttgcgcgtgcagtgggtacgggctgactagagtgcagtaggggagtctggaattcctggtgtagcggtgaaatgcgcagatatcaggaggaacaccggtggcgaaggcgggactctgggctgtaactgacactgaggagcgaaagcatggggagcgaacaggattagataccctggtagtccatgccgtaaacgttgggcactaggtgtgggggacattccacgttctccgcgccgtacgtaacgcattaagtgccccgcctggggagtacggtcgcaaggctaaaactcaaaggaattgacgggggccgcacaagcggcggagcatgcggattaattcgatgcaacgcgaagaaccttaccaaggcttgacatacactggaccgttctggaaacagttcttctctttggagctggtgtacaggtggtgcatggttgtcgtcagctcgtgtcgtgagatgttgggttaagtcccgcaacgagcgcaaccctcgttctatgttgccagcacgtgatggtgggaactcataggagactgccggggtcaactcggaggaaggtggggatgacgtcaaatcatcatgccctttatgtcttgggcttcacgcatgctacaatggctggtacagagagaggcgaacccgtgagggtaagcgaatcccttaaagccagtctcagttcggatcgtagtctgcaattcgactacgtgaagtcggagtcgctagtaatcgcagatcagcaacgctgcggtgaatacgttcccgggccttgtacacaccgcccgtcaagtcacgaaagtcggtaacacccgaagccggtgtcccaacccttttgggagggggccgtctaaggtgggactggtgattgggactaagtcgtaacaaggtagccgtaccggaaggtgcgctggatcacct

SEQ ID NO: 422 - DNA, 1540 bp, Brevibacterium frigoritolerans
gtttgatcctggctcaggacgaacgctggcggcgtgcctaatacatgcaagtcgagcgaatcgacgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaggtgggacagatgattggggtgaagtcgtaacaaggtagccgtatcggaaggtgcggctggatcacctcctt

SEQ ID NO: 423 - DNA, 1515 bp, Brevibacterium linens
tcaggacgaacgctggctgcgtgcttaacacatgcaagtcgaacgctgaagccctggtgcttgcaccggggtggatgagtggcgaacgggtgagtaacacgtgagtaacctgcccccgacttcgggataagcccgggaaactgggtctaataccggatatgacsaysrmtsgcatswktgrtkgtggaaagttttttcggttggggatgggctcgcggcctatcagtttgttggtgaggtaatggctcaccaagacgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagaagcctttcggggtgacggtacctgcagaagaagtaccggctaactacgtgccagcagccgcggtaatacgtagggtacaagcgttgtccggaattattgggcgtaaagagctcgtaggtggttggtcacgtctgctgtggaaacgcaacgcttaacgttgcgcgtgcagtgggtacgggcttgactagagtgcagtaggggagtctggaattcctggtgtagcggtgaaatgcgcagatatcaggaggaacaccggtggcgaaggcgggactctgggctgtaactgacactgaggagcgaaagcatggggagcgaacaggattagataccctggtagtccatgccgtaaacgttgggcactaggtgtgggggacattccacgttctccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgactatacaccagaccgttctggaaacagttcctcccctttggggttggtgtacaggtggtgcatggttgtcgtcagctcgtgtcgtgagatgttgggttaagtcccgcaacgagcgcaaccctcgttctatgttgccagcacgtaatggtgggaactcataggagactgccggggtcaactcggaggaaggtggggatgacgtcaaatcatcatgccctttatgtcttgggcttcacgcatgctacaatggctggtacagagagatgcgagaccgcgaggttttagcgaatcccttaaagccagtctcagttcggatcgtagtctgcaattcgactacgtgaagtcggagtcgctagtaatcgcagatcagcaacgctgcggtgaatacgttcccgggccttgtacacaccgcccgtcaagtcacgaaagtcggtaacacccgaagccggtggcccaacccttgtggagggggccgtctaaggtgggactggtgattgggactaagtcgtaacaaggtagccgtaccggaaggtgcggctggatcacctcctttct

SEQ ID NO: 424 - DNA, 1527 bp, Brevibacterium mcbrellneri
tttttgtggagagtttgatcctggctcaggacgaacgctggcggcgtgcttaacacatgcaagtcgaacgctgaagcttggtgttttcactgggtggatgagtggcgaacgggtgagtaacacgtgagtaacctgccctttacttcgggataagcttgggaaactgggtctaataccggatattctgcgtgatcgtatggttgtgtaggaaagattttttggtaagggatgggctcgcggcctatcagtttgttggtggggtgatggcctaccaagacgacgacgggtagccggcctgagagggcgaccggccacactgggactgagacacggcccagactcctacgggaggcagcagtggggaatattgcacaatgggggaaaccctgatgcagcgacgccgcgtgggggatgacggccttcgggttgtaaacctctttcagtagggaagaagcgtaagtgacggtacctgcagaagaagtaccggctaactacgtgccagcagccgcggtaatacgtagggtactagcgttgtccggaattattgggcgtaaagagctcgtaggtggtttgtcgcgtctgctgtggaaacgtgccgcttaacggtgcgcgtgcagtgggtacgggcggactagagtgcagtaggggagtctggaattcctggtgtagcggtgaaatgcgcagatatcaggaggaacaccggtggcgaaggcgggactctgggctgttactgacgctgaggagcgaaagcatggggagcgaacaggattagataccctggtagtccatgccgtaaacgttgggcactaggtgtggggtccattccacggattctgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcactggatcgctgcagagatgtggttttctttttgactggtgtacaggtggtgcatggttgtcgtcagctcgtgtcgtgagatgttgggttaagtcccgcaacgagcgcaaccctcgttctatgttgccagcacgtgatggtgggaactcatgggagactgccggggtcaactcggaggaaggtggggatgacgtcaaatcatcatgccctttatgtcttgggcttcacgcatgctacaatggccggtacagagggtggcgataccgtgaggtggagcgaatctcttaaagccggtctcagttcggatcgtagtctgcaactcgactacgtgaagtcggagtcgctagtaatcgcagatcagcaatgctgcggtgaatacgttcccgggccttgtacacaccgcccgtcaagtcacgaaagtcggtaacacccgaagccggtggcctaaccttttggggggagccgtcgaaggtgggactggtgattgggactaagtcgtaacaaggtagccgtaccggaaggtgcggctggatcacctcctttct

SEQ ID NO: 425 - DNA, 1441 bp, Brevibacterium paucivorans
gaagctggcggcgtgcttaacacatgcaagtcgaacgatgaagctctagcttgctggggtggattagtggcgaacgggtgagtaacacgtgagtaacctgccctttacttcgggataagcttgggaaactgggtctaataccggatattctgcatggtcggatggttgtgtaggaaagattttttggtaagggatgggctcgcggcctatcagtttgttggtggggtgatggcctaccaagacgacgacgggtagccggcctgagagggcgaccggccacactgggactgagacacggcccagactcctacgggaggcagcagtggggaatattgcacaatgggggaaaccctgatgcagcgacgccgcgtgggggatgacggccttcgggttgtaaacctctttcagtagggaagaagcgaaagtgacggtacctgcagaagaagtaccggctaactacgtgccagcagccgcggtaatacgtagggtactagcgttgtccggaattattgggcgtaaagagctcgtaggtggtttgtcgcgtctgctgtggaaacgtgccgcttaacggtgcgcgtgcagtgggtacgggcggactagagtgcagtaggggagtctggaattcctggtgtagcggtgaaatgcgcagatatcaggaggaacaccggtggcgaaggcgggactctgggctgttactgacgctgaggagcgaaagcatggggagcgaacaggattagataccctggtagtccatgccgtaaacgttgggcactaggtgtggggtccattccacggattctgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcactagaccatcgcagagatgtggttttctttttgactggtgtacaggtggtgcatggttgtcgtcagctcgtgtcgtgagatgttgggttaagtcccgcaacgagcgcaaccctcgttctatgttgccagcacgtgatggtgggaactcatgggagactgccggggtcaactcggaggaaggtggggatgacgtcaaatcatcatgccctttatgtcttgggcttcacgcatgctacaatggccggtacagagggtggcgataccgtgaggtggagcgaatctcttaaagccggtctcagttcggatcgtagtctgcaactcgactacgtgaagtcggagtcgctagtaatcgcagatcagcaatgctgcggtgaatacgttcccgggccttgtacacaccgcccgtcaagtcacgaaagtcggtaacacccgaagccggtggcctaaccctgtgtggggggagccgtcgaaggtgggactggtgattgggact

SEQ ID NO: 426 - DNA, 1341 bp, Brevibacterium sanguinis
gagtttgatcctggctcaggacgaacgctggctgcgtgcttaacacatgcaagtcgaacgagtggcgaacgggtgagtaacacgtgagtaacctgcccctgacttcgggataagcccgggaaactgggtctaataccggatacggaaagtcggttggggatgggctcgcggcctatcagtttgttggtgaggtaatggctcaccaagacgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagatgacggtacctgcagaagaagtaccggctaactacgtgccagcagccgcggtaatacgtagggtacgagcgttgtccggaattattgggcgtaaagagctcgtaggtggttggtcacgtctgctgtggaaacgcaacgcttaacgttgcgcgtgcagtgggtacgggctgactagagtgcagtaggggagtctggaattcctggtgtagcggtgaaatgcgcagatatcaggaggaacaccggtggcgaaggcgggactctgggctgactgacactgaggagcgaaagcatggggagcgaacaggattagataccctggtagtccatgccgtaaacgttgggcactaggtgtgggggtctccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgacatatacaggtggtgcatgttgtcgtcagctcgtgtcgtgagatgttgggttaagtcccgcaacgagcgcaaccctcgttctatgttgccagcacgtgggaactcataggagactgccggggtcaactcggaggaaggtggggatgacgtcaaatcatcatgccctttatgtcttgggcttcacgcatgctacaatggctggcaaagagaagcgaacccgtgagggtcagcgaatcccttccagtctcagttcggacgtagtctgcaattcgactacggaagtcggagtcgctagtaatcgcagatcagcaacgctgcggtgaatacgttcccgggccttgtacacaccgcccgtcaagtcacgaaagtcggtaacacccgaagccggtgcctagggggccgtctaaggtgggactggtgattgggactaagtcgtaacaaggtagccgtaccg

SEQ ID NO: 427 - DNA, 1367 bp, Brevibacterium sp.
  H15
gagtttgatcctggctcaggacgaacgctggctgcgtgcttaacacatgcaagtcgaacgagtggcgaacgggtgagtaacacgtgagtaacctgcccctgacttcgggataagcccgggaaactgggtctaataccggatacggaaagtcggttggggatgggctcgcggcctatcagtttgttggtgaggtaatggctcaccaagacgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagatgacggtacctgcagaagaagtaccggctaactacgtgccagcagccgcggtaatacgtagggtacgagcgttgtccggaattattgggcgtaaagagctcgtaggtggttggtcacgtctgctgtggaaacgcaacgcttaacgttgcgcgtgcagtgggtacgggctgactagagtgcagtaggggagtctggaattcctggtgtagcggtgaaatgcgcagatatcaggaggaacaccggtggcgaaggcgggactctgggctgactgacactgaggagcgaaagcatggggagcgaacaggattagataccctggtagtccatgccgtaaacgttgggcactaggtgtgggggtctccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgacatatacaggtggtgcatggttgtcgtcagctcgtgtcgtgagatgttgggttaagtcccgcaacgagcgcaaccctcgttctatgttgccagcacgtgggaactcataggagactgccggggtcaactcggaggaaggtggggatgacgtcaaatcatcatgccctttatgtcttgggcttcacgcatgctacaatggctggcagagagaggcgaacccgtgagggcaagcgaatcccttccagtctcagttcggacgtagtctgcaattcgactacggaagtcggagtcgctagtaatcgcagatcagcaacgctgcggtgaatacgttcccgggccttgtacacaccgcccgtcaagtcacgaaagtcggtaacacccgaagccggtgcctagggggccgtctaatgtgggactggtgattgggactaattcgtaacaaggtagccgtaccggaaggtgcggctggatcacctcctt

SEQ ID NO: 428 - DNA, 1491 bp, Brevibacterium sp.
  JC43
tagagtttgatcctggctcaggacgaacgctggcggcgtgcttaacacatgcaagtcgaacgatgaagctcctgcttgcaggagtggattagtggcgaacgggtgagtaacacgtgagtaacctgcccctgactgcgggataagcccgggaaactgggtctaataccgcatatgacacctggccgcatggtctgggtgtggaaagtttttcggttggggatgggctcgcggcctatcagcttgttggtggggtaacggcctaccaaggcgacgacgggtagccggcctgagagggcgaccggccacactgggactgagacacggcccagactcctacgggaggcagcagtggggaatattgcacaatgggggaaaccctgatgcagcgacgccgcgtgagggatgacggccttcgggttgtaaacctctttcagtagggaagaagccttcgggtgacggtacctgcagaagaagtaccggctaactacgtgccagcagccgcggtaatacgtagggtacaagcgttgtccggaattattgggcgtaaagagctcgtaggcggttcgtcgcgtctgctgtggaaacgcaaggctcaaccttgcgcgtgcagtgggtacgggcggactagagtgcagtaggggagtctggaattcctggtgtagcggtgaaatgcgcagatatcaggaggaacaccggtggcgaaggcgggactctgggctgtaactgacgctgaggagcgaaagcatggggagcgaacaggattagataccctggtagtccatgccgtaaacgttgggcactaggtgtggggctcattccacgagttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacactggaatgtgccagagatggttcagcccttttgggctggtgtacaggtggtgcatggttgtcgtcagctcgtgtcgtgagatgttgggttaagtcccgcaacgagcgcaaccctcgttctatgttgccagcacgtgatggtgggaactcataggagactgccggggtcaactcggaggaaggtggggatgacgtcaaatcatcatgccctttatgtcttgggcttcacgcatgctacaatggtcggtacaaagggttgcgatgccgtgaggtggagcgaatcccagaaagccgatctcagttcggatcgtagtctgcaactcgactacgtgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaaggtgggactggtgattgggactaagtcgtaacaaggtagccgta

SEQ ID NO: 429 - DNA, 1449 bp, Brevundimonas subvibrioides
agagtttgatcctggctcagagcgaacgctggcggcaggcctaacacatgcaagtcgaacggacctctcggggttagtggcggacgggtgagtaacacgtgggaacgtgccttttggttcggaatagctcctggaaacgggtggtaatgccgaatgtgccctttgggggaaagatttatcgccattagagcggcccgcgtctgattagctagttggtgaggtaaaggctcaccaaggctacgatcagtagctggtctgagaggatgaccagccacattgggactgagacacggcccaaactcctacgggaggcagcagtggggaatcttgcgcaatgggcgaaagcctgacgcagccatgccgcgtgtatgatgaaggtcttaggattgtaaaatactttcaccggtgaagataatgactgtagccggagaagaagccccggctaacttcgtgccagcagccgcggtaatacgaagggggctagcgttgctcggaattactgggcgtaaagggagcgtaggcggacatttaagtcaggggtgaaatcccagagctcaactctggaactgcctttgatactgggtgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacaggattagataccctggtagtccacgccgtaaacgatgattgctagttgtcgggatgtttacatctcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccagagagatctggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgatgcgctaaccgcaaggaggcagtcgaccacggtagggtcagcgactggggtgaagtcgtaacaaggtagccgtaggggaacctgcggctggatcacct

SEQ ID NO: 430 - DNA, 1493 bp, Brucella abortus
aacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaaggaag

SEQ ID NO: 431 - DNA, 981 bp, Brucella canis
tgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatgcctatgaatgttagtggagacactttcagcctttcggggcgtaggacacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagaatgccgcggtgaatacgttcccgggccttgtacacaccgcccgtcacaccatgggagttggttttacccgaaggcgctgtgctaaccgcaaggaggcag

SEQ ID NO: 432 - DNA, 1485 bp, Brucella ceti
caacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctccttt

SEQ ID NO: 433 - DNA, 1500 bp, Brucella melitensis
aattttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaaggaag

SEQ ID NO: 434 - DNA, 1390 bp, Brucella microti
caggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactgggg

SEQ ID NO: 435 - DNA, 1489 bp, Brucella ovis
ttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttct

SEQ ID NO: 436 - DNA, 1489 bp, Brucella sp.
  83/13
ttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccgaaaggggaaagatttatcggcaaatgatcggcccgcgttggattagctagttggtggggtaaaggcccaccaaggcgacgatccatagctggtctgagaggatgatcagccacactgggactgagacacggcccagactcttacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggtaggcgaccacggtagggtcagcgactggggtgaagtcgtaacaaggtagccgtaggggaacctgcggctggatcacctcctttct

SEQ ID NO: 437 - DNA, 1412 bp, Brucella sp.
  BO1
ctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccgaaaggggaaagatttatcggcaaatgatcggcccgcgttggattagctagttggtggggtaaaggcccaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtg

SEQ ID NO: 438 - DNA, 1493 bp, Brucella suis
aacttgagagtttgatcctggctcagaacgaacgctggcggcaggcttaacacatgcaagtcgagcgctccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcagctggatcacctcctttctaaggaag

SEQ ID NO: 439 - DNA, 1535 bp, Bryantella formatexigens
ttttatttgagagtttgatcctggctcaggatgaacgctggcggcgtgcttaacacatgcaagtcgagcgaagcattttaaatgaagttttcggacggaatttaaaatgactgagcggcggacgggtgagtaacgcgtggataacctgccttatacagggggataacagccagaaatggctgctaataccgcataagcgcacggtaccgcatggtacagtgtgaaaaactccggtggtataagatgggtccgcgttggattaggcagttggcggggtaaaggcccaccaaaccgacgatccatagccggcctgagagggtggacggccacattgggactgagacacggcccagactcctacgggaggcagcagtggggaatattgcacaatgggggaaaccctgatgcagcgacgccgcgtgggtgaagaagtatttcggtatgtaaagccctatcagcagggaagaaaatgacggtacctgaccaagaagccccggctaactacgtgccagcagccgcggtaatacgtagggggcaagcgttatccggatttactgggtgtaaagggagcgtagacggccatgcaagtctggtgtgaaaggcgggggctcaacccccggactgcattggaaactgtatggcttgagtgccggagaggtaagcggaattcctggtgtagcggtgaaatgcgtagatatcaggaggaacaccagtggcgaaggcggcttactggacggtaactgacgttgaggctcgaaagcgtggggagcaaacaggattagataccctggtagtccacgccgtaaacgatgaataccaggtgtcgggggacacggtccttcggtgccgcagcaaacgcactaagtattccacctggggagtacgttcgcaagaatgaaactcaaaggaattgacggggacccgcacaagcggtggagcatgtggtttaattcgaagcaacgcgaagaaccttaccaggtcttgacatccggacgaccggacagtaacgtgtccttcccttcggggcgtccgagacaggtggtgcatggttgtcgtcagctcgtgtcgtgagatgttgggttaagtcccgcaacgagcgcaacccctgttcccagtagccagcattcaggatgggcactctggggagactgccagggataacctggaggaaggcggggatgacgtcaaatcatcatgccccttatgatctgggctacacacgtgctacaatggcgtgaacagagggaagcgaacccgcgagggggagcaaatcccagaaataacgtcccagttcggattgtagtctgcaacccggctacatgaagctggaatcgctagtaatcgcggatcagcatgccgcggtgaatacgttcccgggtcttgtacacaccgcccgtcacaccatgggagtcggaaatgcccgaagtcagtgacccaaccggaaggagggagctgccgaaggcggggccggtaactggggtgaagtcgtaacaaggtagccgtatcggaaggtgcggctggatcacctcctttct

SEQ ID NO: 440 - DNA, 1519 bp, Buchnera aphidicola
agagtttgatcatggctcagattgaacgctggcggcaagcttaacacatgcaagtcgagcggcatcgaagaaaagtttacttttctggcggcgagcggcaaacgggtgagtaacatctggggatctacctaaaagagggggacaaccattggaaacgatggctaataccgcataatgtttttaaataaaccaaagtaggggactaaaatttttagccttatgcttttagatgaacccagacgagattagcttgatggtaaggtaatggcttaccaaggcgacgatctctagctggtctgagaggataaccagccacactggaactgagatacggtccagactcctacgggaggcagcagtggggaatattgcacaatgggctaaagcctgatgcagctatgccgcgtgtatgaagaaggccttagggttgtaaagtactttcagcggggaggaaagaattatgtctaatatacatattttgtgacgttacccgaagaagaagcaccggctaactccgtgccagcagccgcggtaatacggagggtgcgagcgttaatcagaattactgggcgtaaagagcacgtaggcggtttattaagtcagatgtgaaatccctaggcttaacttaggaactgcatttgaaactaatagactagagtctcatagagggaggtagaattctaggtgtagcggtgaaatgcgtagatatctagaggaatacccgtggcgaaagcgacctcctaaatgaaaactgacgctgaggtgcgaaagcgtggggagcaaacaggattagataccctggtagtccatgctgtaaacgatgtcgacttggaggttgtttcctagagaagtggcttccgaagctaacgcattaagtcgaccgcctggggagtacggtcgcaaggctaaaactcaaatgaattgacgggggcccgcacaagcggtggagcatgtggtttaattcgatgcaacgcgaagaaccttacctggtcttgacatccatagaattttttagagataaaagagtgccttagggaactatgagacaggtgctgcatggctgtcgtcagctcgtgttgtgaaatgttgggttaagtcccgcaacgagcgcaacccctatcctttgttgccatcaggttatgctgggaactcagaggagactgccggttataaaccggaggaaggtggggatgacgtcaagtcatcatggcccttacgaccagggctacacacgtgctacaatggcatatacaaagagatgcaactctgcgaagataagcaaacctcataaagtatgtcgtagtccggactggagtctgcaactcgactccacgaagtaggaatcgctagtaatcgtggatcagaatgccacggtgaatacgttcccgggccttgtacacaccgcccgtcacaccatgggagtgggttgcaaaagaagcaggtagcttaaccagattattttattggagggcgcttaccactttgtgattcatgactggggtgaagtcgtaacaaggta

SEQ ID NO: 441 - DNA, 1528 bp, Bulleidia extructa
tcaaatgaagagtttgatcctggctcaggataaacgctggcggcgtgcctaatacatgcaagtcgaacgccggacacctagcttgctagggagaaggagtggcgaacgggtgagtaatacataagcaatctgcccacaaagactgggataacctctggaaacggggactaataccggataggtaggagagaggcatctttcttctattaaagatgagaagcactagtggatgagcttatggcgcattagttagttggtgaggtaacggcccaccaagacgatgatgcgtagccggcctgagagggtgaacggccacattgggactgagacacggcccagactcctacgggaggcagcagtagggaattttcggcaatggggggaaccctgaccgagcaacgccgcgtgagtgaagacggccttcgggttgtaaagctctgttgtaagaaaagataaactaggagaggatcttagtcagacattatcttaccagaaagccacggctaactacgtgccagcagccgcggtaatacgtaggtggcgagcgttatccggaattattgggcgtaaagggtgcgtaggcggtctgttaagttcatggtcaaattgtggggctcaaccccatcgcgccatggatactggcagactagagtattggagaggcaagtggaattccatgtgtagcggtaaaatgcgtagatatatggaggaacaccggtggcgaaggcgacttgctagccaaagactgacgctgaggcacgaaagcgtggggagcaaataggattagataccctagtagtccacgctgtaaacgatgaatactaagtattggggagactcagtgctgcagctaacgcattaagtattccgcctgtggagtatgcacgcaagtgtgaaacataaaggaattgacgggggcccgcacaagcggtggagtatgtggtttaattcgacgcaacgcgaagaaccttaccaggccttgacatcccttgcgaagttctagagataggatagaggttatcaaggagacaggtggtgcatggttgtcgtcagctcgtgtcgtgagatgttgggttaagtcccgcaacgagcgcaacccttgtcttcagttaccatcattaagttggggactctggagagactgccggtgataaaccggaggaaggtggggatgacgtcaaatcatcatgccccttatggcctgggctacacacgtactacaatggctattacaacgtggagcgactgtgcgaacagaagcgaatcactgaaagatagtctcagttcggattggagtctgcaactcgactccatgaagttggaatcgctagtaatcgcggatcagcatgccgcggtgaatacgttctcgggccttgtacacaccgcccgtcataccatgagagttggtaatacccgaagccggtggcctaaccgaaaggaaggagccgtcgaaggtaggactaatgattggggtcaagtcgtaacaaggtatccctacgagaacgtggggatggatcacctcctttct

SEQ ID NO: 442 - DNA, 1537 bp, Burkholderia ambifaria
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggttctaatacagccgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttcc

SEQ ID NO: 443 - DNA, 1537 bp, Burkholderia cenocepacia
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatccatggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagccgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttcc

SEQ ID NO: 444 - DNA, 1494 bp, Burkholderia cepacia
agtttgatcctggctcagattgaacgctagcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctatggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgttccagcaatgccgcgtgtgtgaagaaggccttcgggttgtaaagcacttttgtccggaaagaaatccttggttctaatacagccgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtaaccaa

SEQ ID NO: 445 - DNA, 1538 bp, Burkholderia mallei
tgaactgaagagtttgatcctggctcagattgaacgctggcggcatgccttacacatgcaagtcgaacggcagcacgggcttcggcctggtggcgagtggtgaacgggtgagtaatacatcggaacatgtcctgtagtgggggatagcccggcgaaagccggattaataccgcatacgatctgaggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcattctggctaatacccggagtggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaagcccgatgagagttgggcgtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcgag

SEQ ID NO: 446 - DNA, 1537 bp, Burkholderia multivorans
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggtcctaatacgatcgggggatgacggtaccggaagaataagcaccggctaactacgtgccagcagccgcggtaatacgtagggtgcgagcgttaatcggaattactgggcgtaaagcgtgcgcaggcggtctgttaagacagatgtgaaatccccgggctcaacctgggaactgcatttgtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaagagattcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttcc

SEQ ID NO: 447 - DNA, 1499 bp, Burkholderia oklahomensis
agattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctgaggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcctaccgactaatactgggtggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatc

SEQ ID NO: 448 - DNA, 1538 bp, Burkholderia pseudomallei
tgaactgaagagtttgatcctggctcagattgaacgctggcggcatgccttacacatgcaagtcgaacggcagcacgggcttcggcctggtggcgagtggcgaacgggtgagtaatacatcggaacatgtcctgtagtgggggatagcccggcgaaagccggattaataccgcatacgatctgaggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcattctggctaatacccggagtggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaagcccgatgagagttgggcgtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcgag

SEQ ID NO: 449 - DNA, 1474 bp, Burkholderia rhizoxinica
gttgatcctggctcagattgaacgctggcggcatgccttacacatgcaagtcggacggcagcgcgggtttcggcctggcggcgagtggcgaacgggtgagtaagacatcggaacgtgtcctggagtgggggatagcccggcgaaagccggattaataccgcatacgctctgaggaggaaagcgggggaccttagggcctcgcgctcaaggggcggccgatggcagattagctagttggtagggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacggcctggctaatacctgggctggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggcttaacctgggaactgcattggtgactggcaggctagagtatggcagagggaggtagaattccacgtgtagcagtgaaatgcgtagagatgtggaggaataccgatggcgaaggcagcctcctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgagaggtgggggtgctcgaaagagaaccggcgcacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcagtctgcaactcgactgcatgaagctggaatcgctagtaatcgcggatcagcatgtcgcggtgaatacgttcccgggtcttgtacacaccgcccgtcacaccatgggagtgggttttaccagaagtggctagtctaaccgcaaggaggacggtcaccacggtaggattcatgactggggtgaagtc

SEQ ID NO: 450 - DNA, 1537 bp, Burkholderia sp.
  383
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggccctaatacggtcgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaattccgctgagaggtggaagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttct

SEQ ID NO: 451 - DNA, 1462 bp, Burkholderia xenovorans
gaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgctctgcggaggaaagcgggggatcttcggacctcgcgctacaggggcggccgatggcagattagctggttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacctctgccctaatacggtggggggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaagtctgctgagaggtggatgtgcccgaaagggagccataacacaggtgctgcatggctgtcgacagctcgtgtcgtgagatgttgggttaagtcccgcaacgagcgcaccccttgtccctagttgctacgcaagagcactccagggagactgccggtgacaacccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgggtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactgggtgaagtcgtaacaag

SEQ ID NO: 452 - DNA, 1543 bp, Burkholderiales bacterium 1_1_47
ttaaacaatagagtttgatcctggctcagattgaacgctggcggaacgctttacacatgcaagtcgaacggtaacgcgggagaagcttgcttctcccggcgacgagtggcgaacgggtgagtaatacatcggaacgtgtccgctcgtgggggacaaccagccgaaaggttggctaataccgcatgagttctacggaagaaagagggggacccgcaagggcctctcgcgagcggagcggccgatgactgattagccggttggtgaggtaacggctcaccaaagcaacgatcagtagctggtctgagaggacgaccagccacactgggactgagacacggcccagactcctacgggaggcagcagtggggaattttggacaatgggcgcaagcctgatccagctattccgcgtgtgggatgaaggccctcgggttgtaaaccacttttgtagagaacgaaaagacaccttcgaataaagggtgttgctgacggtactctaagaataagcaccggctaactacgtgccagcagccgcggtaatacgtagggtgcgagcgttaatcggaattactgggcgtaaagggtgcgcaggcggttgagtaagacagatgtgaaatccccgagcttaactcgggaatggcatatgtgactgctcgactagagtgtgtcagagggaggtggaattccacgtgtagcagtgaaatgcgtagatatgtggaagaacaccgatggcgaaggcagcctcctgggacataactgacgctcaggcacgaaagcgtggggagcaaacaggattagataccctggtagtccacgccctaaacgatgttaactagttgttgggaagtaaaattctcagtaacgcagccaacgcgagaagttaaccgcctgggaagtacggtcgcaagactaaaactcaaaggaattgacggggacccgcacaagcggtggatgatgtggattaattcgatgcaacgcgaaaaaccttacctacccttgacatgtcaggaagctcttgtaatgagagtgtgcccgcaagggagcctgaacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatgggtagggcttcacacgtcatacaatggtcggaacagagggcagcgaagtcgtgagacggagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcaaacaatgggagtggtgtttaccagaagtcgttagcctaaccgcaaggagggcggcgaccacggtgagcaccgtgactaatgttaagtcgtaacaaggtagccgtaccggaaggtgcggctggatcacctcctttc

SEQ ID NO: 453 - DNA, 1481 bp, Butyricicoccus pullicaecorum
agtttgatcctggctcaggatgaacgctggcggcgtgcctaacacatgcaagtcgaacggagttgtttgaggaaatccttcgggatggaatcttccaacttagtggcggacgggtgagtaacgcgtgagcaatctgcctttcagagggggataacagccggaaacggctgctaataccgcataatgcattgaattcgcatgtttttgatgccaaagattttatcgctgaaagatgagctcgcgtctgattagctagttggcggggtaacggcccaccaaggcgacgatcagtagccggactgagaggttgaacggccacattgggactgaggacacggcccagactcctaccgggaggcagcagtggggaatattgcgcaatgggggcaaccctgacgcagcaacgccgcgtgattgatgaaggtcttcggattgtaaaaatctttaatcagggacgaaacaaatgacggtacctgaagaataagctccggctaactacgtgccagcagccgcggtaatacgtagggagcaagcgttatccggatttactgggtgtaaagggcgtgtaggcgggcttgtaagttggaagtgaaatctcggggcttaaccccgaaactgctttcaaaactgcgagtcttgagtgatggagaggcaggcggaattcccagtgtagcggtgaaatgcgtagatattgggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccggagttaacacaataagtatcccacctggggagtacggccgcaaggttgaaactcaaaggaattgacgggggcccgcacaagcagtggagtatgtggtttaattcgaagcaacgcgcaagaaccttaccaagtcttgacatcccgatgaccgctcyagagatagggcttttcttcggaacatcggtgacaggtggtgcatggttgtcgtcagctcgtgtcgtgagatgttgggttaagtcccgcaacgagcgcaacccttacgggttagttgctacgcaagagcactctagccggactgccgttgacaaaacggaggaaggtggggacgacgtcaaatcatcatgccccttatgacttgggctacacacgtactacaatggcagtcatacagagggaagcaaaaccgcgaggtggagcaaatccctaaaagctgtcccagttcagattgcaggctgcaactcgcctgcatgaagtcggaattgctagtaatcgcggatcagcatgccgcggtgaatacgttcccgggccttgtacacaccgcccgtcacaccatgagagccggtaatacccgaagtccgtagtctaaccgcaaggaggacgcggccgaaggtaggactggtaattgggacgaagtcgt

SEQ ID NO: 454 - DNA, 1379 bp, Butyricimonas virosa
  modified_base (14)..(14): a, c, t, g, unknown or other
ggggcagcgcgggnagtagcaatactctcgccggcgaccggcgcacgggtgagtaacacgtgtgcaaccaaccccgtaccgggagataacccgcggaaacgtggactaacatcccataagactctagagccgcatggctctggatttaaaattccggtggtacgggacgggcacgcgcgacattaggtagttggcggggtaacggcccaccaagccgacgatgtctaggggttctgagaggaaggtcccccacactggaactgagacacggtccagactcctacgggaggcagcagtgaggaatattggtcaatgggcgagagcctgaaccagccaagtcgcgtgagggaagaatggtctatggcctgtaaacctcttttgtcaaggaagaataaaaggtacgtgtaccttcttgccagtacttgacgaataagcatcggctaactccgtgccagcagccgcggtaatacgggggatgcgagcgttatccggatttattgggtttaaagggcgcgtaggcgggacccaagtcagcggtaaaagactgcagctaaactgtagcacgccgttgaaactggcgacctcgagacgagacgagggaggcggaacaagtgaagtagcggtgaaatgcttagatatcacttggaaccccgatagcgaaggcagcttcccaggctcgatctgacgtgatgcgcgagagcgtgggtagcgaacaggattagataccctggtagtccacgccgtaaacgatgctcactggatcttggcgatacactgccagggttcaagcgaaagtattaagtgagccacctggggagtacgtcggcaacgatgaaactcaaaggaattgacgggggcccgcacaagcggaggaacatgtggtttaattcgatgatacgcgaggaaccttacccgggtttaaatgtattttgcatttcttggaaacaggaattcccttcggggctagatacaaggtgctgcatggttgtcgtcagctcgtgccgtgaggtgtcgggttaagtcccataacgagcgcaacccctatcgccagttgccagcggctgaggccgggcactctgtcgagactgccaccgtaaggtgcgaggaaggcggggatgacgtcaaatcagcacggcccttacacccggggcgacacacgtgttacaatggccggtacagagggcagccacggggtgacccggagcgaatctctaaagccggtcgtagttcggactggagtctgcaacccgactccacgaagttggattcgctagtaatcgcgcatcagccatggcgcggtgaatacgttcccgggccttgtacacaccgcccgtcaagccatggaagccgggagtacctgaagatcgtgaccgcgagga

SEQ ID NO: 455 - DNA, 1526 bp, Butyrivibrio crossotus
tttatatgagagtttgatcctggctcaggatgaacgctggcggcgtgcttaacacatgcaagtcgaacgaagcacttcataaagcttgctttaagaagtgacttagtggcggacgggtgagtaacgcgtgggtaacctgccttacacagggggataacagttagaaatgactgctaataccgcataaaacagcagagtcgcatgactcaactgtcaaagatttatcggtgtaagatggacccgcgtctgattagcttgttggtggggtaacggcctaccaaggcgacgatcagtagccggcctgagagggtgaacggccacattgggactgagacacggcccaaactcctacgggaggcagcagtggggaatattggacaatgggcgaaagcctgatccagcgacgccgcgtgagcgatgaagtatttcggtatgtaaagctctatcagcagggaagaaaacgacggtacctgactaagaagccccggctaactacgtgccagcagccgcggtaatacgtagggggcaagcgttatccggatttactgggtgtaaagggagcgtagacggcatcacaagtcagaagtgaaaatccggggctcaaccccggaactgcttttgaaactgtggagctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttgggtttcataagaagctcggtgccggcgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatcccgttgacctgttatgtaatgtaacatctcttcggagcaacggagacaggtggtgcatggttgtcgtcagctcgtgtcgtgagatgttgggttaagtcccgcaacgagcgcaacccttgtccttagtagccagcagtaagatgggcactctagggagactgccggggataactcggaggaaggtggggacgacgtcaaatcatcatgccccttatgacttgggctacacacgtgctacaatggcgtaaacaaagggaagcgaacctgtgaaggcaagcaaatcccaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgtaaatgcccgaagtcggtgacctaaccgtaaggaaggagccgccgaaggcaggtatgataactggggtgaagtcgtaacaaggtagccgtatcggaaggtgcggctggatcacctcctttct

SEQ ID NO: 456 - DNA, 1477 bp, Butyrivibrio fibrisolvens
tggcggcgtgcctaacacatgcaagtcgaacggagttattcgctgatgaagcttcggcagaatcttgaataacttagtggcggacgggtgagtaacgcgtgggtaacctgcctcatacagggggatagcagttggaaacgactgataacaccgcataagcgcacagtgtcgcatgacacagtgtgaaaatatttataggtatgagatggacccgcgtctgattagctagttggtgaggtaacggcccaccaaggcgacgatcagtagccggcctgagagggcggacggccacattgggactgagacacggcccaaactcctacgggaggcagcagtgggggatattgcacaatgggcgaaagcctgatgcagcgacgccgcgtgagtgaagaagtatttcggtatgtaaagctctatcagcagggaagaaagacctcgtaagaggggatgacggtacctgagtaagaagccccggctaactacgtgccagcagccgcggtaatacgtagggggcaagcgttatccggatttactgggtgtaaagggagcgtagacggtgtatcaagtctgaagtgaaaccccacggctcaaccgtgggcttgctttggaaactggtagactagagtactggagaggtaagcggaattcctggtgtagtagtgaaatgcgtagatatcaggaagaacatcagtggcgaaggcggcttactggacagcaactgacgttgaggctcgaaagcgtggggagcaaacaggattagataccctggtagtccacgccgtaaacgatgaatactaggtgttgggagacatagtctttcagtgccggcgctaacgcaataagtattccacctggggagtacgttcgcaagaatgaaactcaaaggaattgacggggacccgcacaagcggtggagcatgtggtttaattcgaagcaacgcgaagaaccttaccaaatcttgagatccagatgaatgatgggtaatgccatcagtccttcgggacatctgagacaggtggtgcatggttgtcgtcagctcgtgtcgtgagatgttgggtcaagtcccgcaacgagcgcaacccttgtccatagtagccagcagtaagatgggcactctatggagactgccagggataacctggaggaaggtggggatgacgtcaaatcatcatgccccttatgatttgggccacacacgtgctacaatgtcgtaacaaagggaagcaaccctgcgaaggtgagcaaatcccaaaaataacgacccagttcggactgtaggctgcaacccgcctgcacgaagctggaatcgctagtaatcgcagatcagaatgctgcggtgaatacgttcccgggtcttgtacacaccgcccgtcacaccatgggagtcggaaatgcccaaagtcagtggcctaaccgtaaggagggagcttgctaaggcaggtcggataactggggtgaagtcgtaacaaggtagcc

SEQ ID NO: 457 - DNA, 1466 bp, Caldimonas manganoxidans
attgaacgctggcggcatgctttacacatgcaagtcgaacggcagcgggtccttcgggatgccggcgagtggcgaacgggtgagtaatgcatcggaacgtacccagtcgtgggggataactactcgaaagagtagctaataccgcatacgacctgagggtgaaagcgggggaccgcaaggcctcgcgcgattggagcggccgatgtcggattagctagttggtggggtaaaggcttaccaaggcgacgatccgtagctggtctgagaggacggccagccacactgggactgagacacggcccagactcctacgggaggcagcagtggggaattttggacaatgggcgcaagcctgatccagccatgccgcgtgcgggaagaaggccttcgggttgtaaaccgcttttgtcagggaagaaaagctctgggctaatacctcggagtgatgacggtacctgaagaataagcaccggctaactacgtgccagcagccgcggtaatacgtagggtgcgagcgttaatcggaattactgggcgtaaagcgtgcgcaggcggttgtgcaagacagatgtgaaatccccgggcttaacctgggaactgcatttgtgactgcacggctagagtgcggcagagggggatggaattccgcgtgtagcagtgaaatgcgtagatatgcggaggaacaccgatggcgaaggcagtcccctgggcctgcactgacgctcatgcacgaaagcgtggggagcaaacaggattagataccctggtagtccacgccctaaacgatgtcaactggttgttggggattcatttcctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgccaggaaccctgcagagatgtgggggtgctcgaaagagagcctggacacaggtgctgcatggccgtcgtcagctcgtgtcgtgagatgttgggttaagtcccgcaacgagcgcaacccttgccattagttgctacgaaagggcactctaatgggactgccggtgacaaaccggaggaaggtggggatgacgtcaggtcctcatggcccttatgggtagggctacacacgtcatacaatggccggtacagagggctgccaacccgcgagggggagccaatcccagaaaaccggtcgtagtccggatcgcagtctgcaactcgactgcgtgaagtcggaatcgctagtaatcgcggatcagcatgtcgcggtgaatacgttcccgggtcttgtacacaccgcccgtcacaccatgggagcgggttctgccagaagtgggtagcctaaccgcaaggagggcgcttaccacggcagggttcgtgactggggtgaagtcgtaacaag

SEQ ID NO: 458 - DNA, 1456 bp, Caminicella sporogenes
tgatcatggctcaggatgaacgctggcggcgtgcctaacacatgcaagtcgagcggagctttaatcttttcagcttagctgaaaagattaaagcttagcggcggacgggtgagtaacgcgtgggcaacctgccctgtgcagggggataacacatcgaaaggtgtgctaataccccataagactacgatgtcgcatggcatagtagtaaaagctgaggcggcacaggatgggcccgcgtctgattagctagttggtagggtaacggcctaccaaggcaacgatcagtagccgacctgagagggtgaacggccacactggaactgagacacggtccagactcctacgggaggcagcagtggggaatattgcacaatgggggaaaccctgatgcagcaacgccgcgtgagcgaagaaggccttcgggtcgtaaagctctgtcctaagggaagaaagatgacggtaccttaggaggaagccccggctaactacgtgccagcagccgcggtaaaacgtagggggcgagcgttatccggaatgactgggcgtaaagggtgtgtaggcggccggtaaagtctggggtgaaaggctacggcttaaccgtagtaagccttggaaacttatcggcttgagtgcaggagaggagagcggaattcctagtgtagcggtgaaatgcgtagatattaggaggaacaccagtggcgaaggcggctctctggactgcaactgacgctgaggcacgaaagcgtggggagcgaacaggattagataccctggtagtccacgccgtaaacgatgagtgctaggtgttggaggttcatactttcagtgccgcagttaacgcattaagcactccgcctggggagtacggtcgcaagactgaaactcaaaggaattgacggggacccgcacaagcagcggagcatgtggtttaattcgaagcaacgcgaagaaccttaccaggacttgacatccctgtgacagcttcttaatcgaagccttcccttcggggacacaggagacaggtggtgcatggttgtcgtcagctcgtgtcgtgagatgttgggttaagtcccgcaacgagcgcaacccttgtctttagttgccagcacttagggtgggcactctaaagagactgccggtgataaaccggaggaaggtgggggatgacgtcaaatcatcatgccccttatgttctgggctacacacgtgctacaatggctggtacaaagggaagcgaaggagtaatccggagcgaatcccaaaaagccagtcccagttcggattgtgggctgcaactcgcccacatgaagccggagttgctagtaatcgcgaatcagaatgtcgcggtgaatacgttcccgggtcttgtacacaccgcccgtcacaccatgggagcccatggcacccgaagtcagtgagtcaaccgtaaaggagacagctgccgaaggtgaaatgg

SEQ ID NO: 459 - DNA, 1517 bp, Campylobacter coli
tttttatggagagtttgatcctggctcagagtgaacgctggcggcgtgcctaatacatgcaagtcgaacgatgaagcttctagcttgctagaagtggattagtggcgcacgggtgagtaaggtatagttaatctgccctacacaagaggacaacagttggaaacgactgctaatactctatactcctgcttaacacaagttgagtagggaaagtttttcggtgtaggatgagactatatagtatcagctagttggtaaggtaatggcttaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattctgacggtacctaaggaataagcaccggctaactccgtgccagcagccgcggtaatacggagggtgcaagcgttactcggaatcactgggcgtaaagggcgcgtaggcggattatcaagtctcttgtgaaatctaatggcttaaccattaaactgcttgggaaactgatagtctagagtgagggagaggcagatggaattggtggtgtaggggtaaaatccgtagatatcaccaagaatacccattgcgaaggcgatctgctggaactcaactgacgctaaggcgcgaaagcgtggggagcaaacaggattagataccctggtagtccacgccctaaacgatgtacactagttgttggggtgctagtcatctcagtaatgcagctaacgcattaagtgtaccgcctggggagtacggtcgcaagattaaaactcaaaggaatagacggggacccgcacaagcggtggagcatgtggtttaattcgaggatacgcgaagaaccttacctgggcttgatatcctaagaaccttttagagataagagggtgctagcttgctagaacttagagacaggtgctgcacggctgtcgtcagctcgtgtcgtgagatgttgggttaagtcccgcaacgagcgcaacccacgtatttagttgctaacggttcggccgagcactctaaatagactgccttcgtaaggaggaggaaggtgtggacgacgtcaagtcatcatggcccttatgcccagggcgacacacgtgctacaatggcatatacaatgagacgcaataccgcgaggtggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaactagttaccgtccacagtggaatcagcgactggggtgaagtcgtaacaaggtaaccgtaggagaacctgcggttggatcacctcctttct

SEQ ID NO: 460 - DNA, 1458 bp, Campylobacter concisus
aatatggagagtttgatcctggctcagagtgaacgctggcggcgtgcctaatacatgcaagtcgaacggacaagtaagagcttgctcttatgagttagtggcgcacgggtgagtaatgtatagctaatctgccctacactagaggacaacagttggaaacgactgctaatactctatactcctgtcttacataagttagatagggaaagtttttcggtgtaggatgaggctatattgtatcagctagttggtgaggtaatggctcaccaaggctatgacgcataactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttgttagggaagaacaatgacggtacctaacgaataagcaccggctaactccgtgccagcagccgcggtaatacggagggtgcaagcgttactcggaatcactgggcgtaaaggacgcgtaggcggattatcaagtctcttgtgaaatcctatggcttaaccatagaactgcttgggaaactgataatctagagtgagggagaggcagatggaattggtggtgtaggggtaaaatccgtagagatcaccaggaatacccattgcgaaggcgatctgctggaactcaactgacgctaatgcgtgaaagcgtggggagcaaacaggattagataccctggtagtccacgccctaaacgatgtatactagttgttgctaagctagtcttggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatctagagatagaagagtgtctgcttgcagaaatgttaagacaggtgctgcacggctgtcgtcagctcgtgtcgtgagatgttgggttaagtcccgcaacgagcgcaacccacgtcattagttgctaacagttcggctgagcactctaatgagactgccttcgtaaggaggaggaaggtgtggacgacgtcaagtcatcatggcccttatgtccggggcgacacacgtgctacaatggcatatacaatgagaagcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagccggaatactaaattagttaccgtccacagtggaatcagcgactgggg

SEQ ID NO: 461 - DNA, 1355 bp, Campylobacter curvus
gtctgcgaagtcgtaatatttaattgcgaagcaagtaaatattacatagggtttctcgctatgggatgaggctatatcgtatcagctagttggtagggtaatggcttaccaaggctatgacgcgtaactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttcttggggaagaaatttgacggtacccaaggaataagcaccggctaactccgtgccagcagccgcggtaatacggagggtgcaagcgttactcggaatcactgggcgtaaaggacgcgtaggcggattatcaagtctcttgtgaaatccaatggcttaaccattgaactgcttgagaaactgataatctagagtgagggagaggcagatggaattggtggtgtaggggtaaaatccgtagagatcaccaggaatacccattgcgaaggcgatctgctggaactcaactgacgctaatgcgtgaaagcgtggggagcaaacaggattagataccctggtagtccacgccctaaacgatgtatactagttgttgctaagctagtcttggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatctagagatagaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgcaaggaggaggaaggtgtggacgacgtcaagtcatcatggcccttatgtccggggcgacacacgtgctacaatggcatatacaatgagacgcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaaccggttatggtccacagtggaatcagcgactggggtgaagtcgtaacaaggtaaccgtaggagaacctgcggttggatcacctcctttct

SEQ ID NO: 462 - DNA, 1521 bp, Campylobacter fetus
tttttatggagagtttgatcctggctcagagtgaacgctggcggcgtgcctaatacatgcaagtcgaacggagtattaagagagcttgctcttttaatacttagtggcgcacgggtgagtaatgtatagttaatctgccctacactggaggacaacagttagaaatgactgctaatactccatactccttcttaacataagttaagtcgggaaagtttttcggtgtaggatgagactatattgtatcagctagttggtaaggtaatggcttaccaaggctttgacgcataactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttgttagggaagaaccatgacggtacctaacgaataagcaccggctaactccgtgccagcagccgcggtaatacggagggtgcaagcgttactcggaatcactgggcgtaaaggacgcgtaggcggattatcaagtcttttgtgaaatctaacagcttaactgttaaactgcttgagaaactgataatctagagtgagggagaggcagatggaattggtggtgtaggggtaaaatccgtagagatcaccaggaatacccattgcgaaggcgatctgctggaactcaactgacgctaatgcgtgaaagcgtggggagcaaacaggattagataccctggtagtccacgccctaaacgatgtatactagttgttgctgtgctagtcacggcagtaatgcacctaacggattaagtataccgcctggggagtacggtcgcaagattaaaactcaaaggaatagacggggacccgcacaagcggtggagcatgtggtttaattcgaagatacgcgaagaaccttacctgggcttgatatccaactaatctcttagagataagagagtgctagcttgctagaaagttgagacaggtgctgcacggctgtcgtcagctcgtgtcgtgagatgttgggttaagtcccgcaacgagcgcaacccacgtatttagttgctaacagttcggctgagcactctaaatagactgccttcgcaaggaggaggaaggtgtggacgacgtcaagtcatcatggcccttatgcccagggcgacacacgtgctacaatggcatatacaatgagatgcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagtcggaatgctaaactagctaccgcccacagtggaatcagcgactggggtgaagtcgtaacaaggtaaccgtaggagaacctgcggttggatcacctcctttctag

SEQ ID NO: 463 - DNA, 1515 bp, Campylobacter gracilis
aatatggagagtttgatcctggctcagagtgaacgctggcggcgtgcctaatacatgcaagtcgaacggaatttaagagagcttgctcttttaaatttagtggcgcacgggtgagtaatatatagctaatctgccccttgctggaggacaacagttagaaatgactgctaatactccatactcctttttaccataagataaatcgggaaagaatttcggcaagggatgagactatatcgtatcagctagtcggtggggtaacggcctaccgaggctatgacgcgtaactggtctgagaggatgatcagtcacattggaactgagacacggtccaaactcctacgggaggcagcagtagggaatattgcgcaatgggggaaaccctgacgcagcaacgccgcgtggaggatgacacttttcggagcgtaaactccttttgttagggaagaataatgacggtacctaacgaataagcaccggctaactccgtgccagcagccgcggtaatacggagggtgcaagcgttactcggaatcactgggcgtaaaggacgcgtaggcggattatcaagtctcttgtgaaatctaacggcttaaccgttaaactgcttgggaaactgataatctagagtaagggagaggcagatggaattcttggtgtaggggtaaaatccgtagatatcaagaagaatacctattgcgaaggcgatctgctggaacttaactgacgctaatgcgtgaaagcgtggggagcaaacaggattagataccctggtagtccacgccctaaacgatgtataccggttgttgctgtgctagtcacggcagtaatccacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatccagagatggaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgtaaggaggaggaaggtgtggacgacgtcaagtcatcatggcccttatgtccggggcgacacacgtgctacaatggcatatacaataagacgcaatatcgtaagatggagcaaatctaaaaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcgggaatgcgaaattcgctaccctccacagtggaatcagcgactggggtgaagtcgtaacaaggtaaccgtaggagaacctgcggttggatcacctcctttct

SEQ ID NO: 464 - DNA, 1515 bp, Campylobacter hominis
tttatatggagagtttgatcctggctcagagtgaacgctggcggcgtgcctaatacatgcaagtcgaacgaacgaataagagcttgctcttataagttagtggcgcacgggtgagtaatatatagctaatctgcctcttagtagaggataacagtcggaaacgattgctaatactctatacttctgctttacataagtaaagtagagaaagtttttcgctaagagatgaggctatactgtatcagctagttggtaaggtaacggcttaccaaggctatgacgcataactggtctgagaggatgatcagtcacattggaactgagacacggtccaaactcctacgggaggcagcagtagggaatattgcgcaatgggggaaaccctgacgcagcaacgccgcgtggaggatgacacttttcggagcgtaaactccttttatcgggaaagaataatgacggtacccgatgaataagcaccggctaactccgtgccagcagccgcggtaatacggagggtgcaagcgttactcggaatcactgggcgtaaagggtgcgtaggtggattatcaagtctcttgtgaaatctaatagcttaactattaaattgcttgggaaactgatagtctagagtaggggagaggcagatggaactcttggtgtaggagtaaaatccgtagatatcaagaagaatacctattgcgaaagcgatctgctagaacctaactgacactgatgcacgaaagcgtggggagcaaacaggattagataccctggtagtccacgccctaaacgatgtataccggttgttgctttgctagtcaaggcagtaatccagctaacgcattaagtataccgcctggggagtacggtcgcaagattaaaactcaaaggaatagacggggacccgcacaagcggtggagcatgtggtttaattcgaagatacgcgaagaaccttacccggacttgatatctaacaaatcatccagagatggaagagtgtctgcttgcagaaatgttaagacaggtgctgcacggctgtcgtcagctcgtgtcgtgagatgttgggttaagtcccgcaacgagcgcaacccacgtatttagttgctaacagttaggctgagttctctaaatagactgccttcgtaaggaggaggaaggtgtggacgacgtcaagtcatcatggcccttatgtccggggcgacacacgtgctacaatgacatatacaatgagatgcaatatcgcaagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcggggatgcaaaatttgctaccctccacagtggaatcagcgactggggtgaagtcgtaacaaggtaaccgtaggagaacctgcggttggatcacctcctttct

SEQ ID NO: 465 - DNA, 1519 bp, Campylobacter jejuni
tttttatggagagtttgatcctggctcagagtgaacgctggcggcgtgcctaatacatgcaagtcgaacgatgaagcttttagcttgctagaagtggattagtggcgcacgggtgagtaaggtatagttaatctgccctacacaagaggacaacagttggaaacgactgctaatactctatactcctgcttaacacaagttgagtagggaaagtttttcggtgtaggatgagactatatagtatcagctagttggtaaggtaatggcttaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattctgacggtacctaaggaataagcaccggctaactccgtgccagcagccgcggtaatacggagggtgcaagcgttactcggaatcactgggcgtaaagggcgcgtaggcggattatcaagtctcttgtgaaatctaatggcttaaccattaaactgcttgggaaactgatagtctagagtgagggagaggcagatggaattggtggtgtaggggtaaaatccgtagatatcaccaagaatacccattgcgaaggcgatctgctggaactcaactgacgctaaggcgcgaaagcgtggggagcaaacaggattagataccctggtagtccacgccctaaacgatgtacactagttgttggggtgctagtcatctcagtaatgcagctaacgcattaagtgtaccgcctggggagtacggtcgcaagattaaaactcaaaggaatagacggggacccgcacaagcggtggagcatgtggtttaattcgaagatacgcgaagaaccttacctgggcttgatatcctaagaaccttatagagatatgagggtgctagcttgctagaacttagagacaggtgctgcacggctgtcgtcagctcgtgtcgtgagatgttgggttaagtcccgcaacgagcgcaacccacgtatttagttgctaacggttcggccgagcactctaaatagactgccttcgtaaggaggaggaaggtgtggacgacgtcaagtcatcatggcccttatgcccagggcgacacacgtgctacaatggcatatacaatgagacgcaataccgcgaggtggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaactagttaccgtccacagtggaatcagcgactggggtgaagtcgtaacaaggtaaccgtaggagaacctgcggttggatcacctcctttctag

SEQ ID NO: 466 - DNA, 1519 bp, Campylobacter lari
tttttatggagagtttgatcctggctcagagtgaacgctggcggcgtgcctaatacatgcaagtcgaacgatgaagcgactagcttgctagttgtggattagtggcgcacgggtgagtaaggtatagttaatctgccctacacaagaggacaacagttggaaacggctgctaatactctatactcctgcttaacacaagttgagtagggaaagtttttcggtgtaggatgagactatatagtatcagctagttggtgaggtaatggctcaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattctgacggtacctaaggaataagcaccggctaactccgtgccagcagccgcggtaatacggagggtgcaagcgttactcggaatcactgggcgtaaagggcgcgtaggcggattatcaagtctcttgtgaaatccaacggcttaaccgttgaactgcttgggaaactggtaatctagagtgggggagaggcagatggaattggtggtgtaggggtaaaatccgtagatatcaccaagaatacccattgcgaaggcgatctgctggaacttaactgacgctaaggcgcgaaagcgtggggagcaaacaggattagataccctggtagtccacgccctaaacgatgtatgctagttgttggggtgctagtcatctcagtaatgcagctaacgcattaagcataccgcctggggagtacggtcgcaagattaaaactcaaaggaatagacggggacccgcacaagcggtggagcatgtggtttaattcgaagatacgcgaagaaccttacctgggcttgatatcctaagaaccttatagagatatgagggtgctagcttgctagaacttagagacaggtgctgcacggctgtcgtcagctcgtgtcgtgagatgttgggttaagtcccgcaacgagcgcaacccacgtatttagttgctaacacttcgggtgagcactctaaatagactgccttcgtaaggaggaggaaggtgtggacgacgtcaagtcatcatggcccttatgcccagggcgacacacgtgctacaatggcatatacaatgagacgcaataccgcgaggtggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaactagttaccgtccacagtggaatcagcgactggggtgaagtcgtaacaaggtaaccgtaggagaacctgcggttggatcacctcctttctag

SEQ ID NO: 467 - DNA, 1515 bp, Campylobacter rectus
ttaatatggagagtttgatcctggctcagagtgaacgctggcggcgtgcctaatacatgcaagtcgaacggagattaagtagcttgctatttaatcttagtggcgcacgggtgagtaatatatagctaatctgccctacactagaggacaacagttggaaacgactgctaatactctatactccttctttacataagttaagtcgggaaagtttttcggtgtaggatgaggctatatcgtatcagctagttggtagggtaacggcctaccaaggctatgacgcgtaactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttcttgggaaagaattatgacggtacccaaggaataagcaccggctaactccgtgccagcagccgcggtaatacggagggtgcaagcgttactcggaatcactgggcgtaaaggacgcgtaggcggattatcaagtctcttgtgaaatctaacggcttaaccgttaaactgcttgggaaactgataatctagagtaagggagaggcagatggaattcttggtgtaggggtaaaatccgtagagatcaagaagaatacccattgcgaaagcgatctgctggaacttaactgacgctaatgcgtgaaagcgtggggagcaaacaggattagataccctggtagtccacgccctaaacgatgtatactagttgttgcttcgctagtcgaggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatccagagatggaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgtaaggaggaggaaggtgtggacgacgtcaagtcatcatggcccttatgtccggggcgacacacgtgctacaatggcgtatacaataagacgcaatatcgcgagatggagcaaatctataaaatacgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaaccggttatggtccacagtggaatcagcgactggggtgaagtcgtaacaaggtaaccgtaggagaacctgcggttggatcacctcctttct

SEQ ID NO: 468 - DNA, 1515 bp, Campylobacter showae
ttaatatggagagtttgatcctggctcagagtgaacgctggcggcgtgcctaatacatgcaagtcgaacggagattaagtagcttgctatttaatcttagtggcgcacgggtgagtaatatatagctaacttgcccattactaagggacaacagttggaaacgactgctaataccttatactccgtatctatataagtagatacgggaaagtttttcggtaatggatagggctatatcgtatcagctagttggtaaggtaatggcttaccaaggctatgacgcgtaactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttcttgggaaagaattatgacggtacccaaggaataagcaccggctaactccgtgccagcagccgcggtaatacggagggtgcaagcgttactcggaatcactgggcgtaaaggacgcgtaggcggattatcaagtctcttgtgaaatctaacggcttaaccgttaaactgcttgggaaactgataatctagagtaagggagaggcagatggaattcttggtgtaggggtaaaatccgtagagatcaagaagaatacccattgcgaaagcgatctgctggaacttaactgacgctaatgcgtgaaagcgtggggagcaaacaggattagataccctggtagtccacgccctaaacgatgtatactagttgttgcttcgctagtcgaggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatccagagatggaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgcaaggaggaggaaggtgtggacgacgtcaagtcatcatggcccttatgtccggggcgacacacgtgctacaatggcatatacaatgagacgcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaaccggttatggtccacagtggaatcagcgactggggtgaagtcgtaacaaggtaaccgtaggagaacctgcggttggatcacctcctttct

SEQ ID NO: 469 - DNA, 1420 bp, Campylobacter sp.
  FOBRC14
agagtgaacgctggcggcgtgcctaatacatgcaagtcgaacggagattaagtagcttgctatttaatcttagtggcgcacgggtgagtaatatatagctaacttgcccattactaagggacaacagttggaaacgactgctaataccttatactccgtatctatataagtagatacgggaaagtttttcggtaatggatagggctatatcgtatcagctagttggtagggtaatggcttaccaaggctatgacgcgtaactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttcttggggaagaaatttgacggtacccaaggaataagcaccggctaactccgtgccagcagccgcggtaatacggagggtgcaagcgttactcggaatcactgggcgtaaaggacgcgtaggcggattatcaagtctcttgtgaaatccaatggcttaaccattgaactgcttgagaaactgataatctagagtgagggagaggcagatggaattggtggtgtaggggtaaaatccgtagagatcaccaggaatacccattgcgaaggcgatctgctggaactcaactgacgctaatgcgtgaaagcgtggggagcaaacaggattagataccctggtagtccacgccctaaacgatgtatactagttgttgctaagctagtcttggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatctagagatagaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgcaaggaggaggaaggtgtggacgacgtcaagtcatcatggcccttatgtccggggcgacacacgtgctacaatggcatatacaatgagacgcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaaccggttatggtccacagtggaa

SEQ ID NO: 470 - DNA, 1428 bp, Campylobacter sp.
  FOBRC15
agtgaacgctggcggcgtgcctaatacatgcaagtcgaacggagattaagtagcttgctatttaatcttagtggcgcacgggtgagtaatatatagctaacttgcccattactaagggacaacagttggaaacgactgctaataccttatactccgtgtctatataagtagatacgggaaagtttttcggtaatggatagggctatatcgtatcagctagttggtaaggtaatggcttaccaaggctatgacgcgtaactggtctgagaggatgatcagtcacactggaactgagacacggtccagactcctacgggaggcagcagtagggaatattgctcaatggggggaaccctgaagcagcaacgccgcgtggaggatgacacttttcggagcgtaaactccttttcttgggaaagaattatgacggtacccaaggaataagcaccggctaactccgtgccagcagccgcggtaatacggagggtgcaagcgttactcggaatcactgggcgtaaaggacgcgtaggcggattatcaagtctcttgtgaaatctaacggcttaaccgttaaactgcttgggaaactgataatctagagtaagggagaggcagatggaattcttggtgtaggggtaaaatccgtagagatcaagaagaatacccattgcgaaagcgatctgctggaacttaactgacgctaatgcgtgaaagcgtggggagcaaacaggattagataccctggtagtccacgccctaaacgatgtatactagttgttgcttcgctagtcgaggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatccagagatggaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgcaaggaggaggaaggtgtggacgacgtcaagtcatcatggcccttatgtccggggcgacacacgtgctacaatggcgtatacaatgagacgcaatatcgcgagatggagcaaatctataaaatacgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaactggttatggtccacagtggaatcagcgactg

SEQ ID NO: 471 - DNA, 1505 bp, Campylobacter sp.
  oral clone BB120
gagagtttgattctggctcagagtgaacgctggcggcgtgcctaatacatgcaagtcgaacggagattaaatagcttgctatttaatcttagtggcgcacgggtgagtaatgtatagttaatctgccccatagtggaggacaacagttagaaatgactgctaatactccatactccttcttatcataagttaagtcgggaaagtttttcgctatgggatgagactatatcgtatcagttagttggtaaggtaatggcttaccaaggctatgacgcgtaactggtctgagaggatgatcagtcacattggaactgagacacggtccaaactcctacgggaggcagcagtagggaatattgcgcaatgggggaaaccctgacgcagcaacgccgcgtggaggatgacacttttcggagcgtaaactccttttgttagggaagaataatgacggtacctaacgaataagcaccggctaactccgtgccagcagccgcggtaatacggagggtgcaagcgttactcggaatcactgggcgtaaaggacgcgtaggcggattatcaagtctcttgtgaaatctagtggcttaaccactaaactgcttgggaaactgataatctagagtaagggagaggcagatggaattcttggtgtaggggtaaaatccgtagagatcaagaagaatacttattgcgaaggcgatctgctagaacttaactgacgctaatgcgtgaaagcgtggggagcaaacaggattagataccctggtagtccacgccctaaacgatgtatactggttgttgctatgctagtcatggcagtaatccacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatctagagatagaagagtgtctgcttgcagaaatgttaagacaggtgctgcacggctgtcgtcagctcgtgtcgtgagatgttgggttaagtcccgcaacgagcgcaacccacgtcattagttgctaacagtttagctgagcactctaatgagactgccttcgtaaggaggaggaaggtgtggacgacgtcaagtcatcatggcccttatgtccagggcgacacacgtgctacaatggcatatacaatgagatgcaatatcgcgagatggagcgaatctataaaatatgtcccagttcggattggagtctgcaactcgactccatgaagtcggaatcgctagtaatcgtagatcagccatgctacggtgaatacgttcccgggtcttgtactcaccgcccgtcacaccatgggagttgatttcactcgaagtcggaatgctaaactagctaccgcccacagtggaatcagcgactggggtgaagtcgtaacaaggtaaccgtaggagaacctgcggytkgawcacctccttc

SEQ ID NO: 472 - DNA, 1695 bp, Campylobacter sputorum
  modified_base (8)..(8): a, c, t, g, unknown or other
agtgaacnctggcggcgtgcctaatacatgcaagtcgaacgatgaagtcctagcttgctaggatggattagtggcgcacgggtgagtaatgtatagctaatctgccccatagagaggaacaacacttagaaatgagtgctaatacctcatactccaattatacataagtttaattgggaaatgtagctcttaataatatatatcaaagataatttataaataaaaagttataaatataacaataagcttttttgaagctttatattaataaagcgaaaaaaaagcaaagcagttagatttaataaatttttatagcatttaaaaatacaaaagacttaatttttaaatctaaatataaattattactaatatttttaatagtcatttagaaatatcttaatatatattattaagagctttcgctatgggatgaggctatattgtatcagctagttggtaaggtaatggcttaccaaggctatgacgcataactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttctttgggaagaataatgacggtaccaaaggaataagcaccggctaactccgtgccagcagccgcggtaatacggagggtgcaagcgttactcggaatcactgggcgtaaaggacgcgtaggtggatagataagtctcttgtgaaatctagtagcttaactactaaactgcttgggaaactatctatctagagtaagggagaggcagatggaattcttggtgtaggggtaaaatccgtagatatcaagaggaatacttattgcgaaggcgatctgctagaacttaactgacactaatgcgtgaaagcgtggggagcaaacaggattagataccctggtagtccacgccctaaacgatgtatactggttgttgctgtgctagtcatggcagtaatccacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatctagagatagaagagtgtctgcttgcagaaatgttaagacaggtgctgcacggctgtcgtcagctcgtgtcgtgagatgttgggttaagtcccgcaacgagcgcaacccacgtgtttagttgctaacagttaggctgagcactctaaacagactgccttcgtaaggaggaggaaggtgtggacgacgtcaagtcatcatggcccttatgtccggggcgacacacgtgctacaatggcatatacaataagacgcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaattggttatggtccacagtggaatcagcgactggggtgaagtcgtaacaaggtaaccgtaggagaac

SEQ ID NO: 473 - DNA, 1513 bp, Campylobacter upsaliensis
tatggagagtttgatcctggctcagagtgaacgctggcggcgtgcctaatacatgcaagtcgaacgatgaagcttttagcttgctagaagtggattagtggcgcacgggtgagtaaggtatagttaatctgccctacactgggggacaacacttagaaatgagtgctaataccccatactcctatttaacataagttaggtagggaaagtttttcggtgtaggatgagactatatagtatcagctagttggtaaggtaaaggcttaccaaggctatgacgcttaactggtctgagaggatgatcagtcacactggaactgagacacggtccagactcctacgggaggcagcagtagggaatattgcgcaatgggcgaaagcctgacgcagcaacgccgcgtggaggatgacacttttcggagcgtaaactccttttctttgggaagaattttgacggtaccaaaggaataagcaccggctaactccgtgccagcagccgcggtaatacggagggtgcaagcgttactcggaatcactgggcgtaaagggcgcgtaggcggattatcaagtctcttgtgaaatctaatggcttaaccattaaactgcttgggaaactgatagtctagagtgagggagaggcagatggaattggtggtgtaggggtaaaatccgtagatatcaccaagaatacccattgcgaaggcgatctgctggaactcaactgacgctaaggcgcgaaagcgtggggagcaaacaggattagataccctggtagtccacgccctaaacgatgtatgctagttgttggggtgctagtcatctcagtaatgcagctaacgcattaagcataccgcctggggagtacggtcgcaagattaaaactcaaaggaatagacggggacccgcacaagcggtggagcatgtggtttaattcgaagatacgcgaagaaccttacctaggcttgatatccaacaaattctgtagagatacggaagtgctagcttgctagaatgttgagacaggtgctgcacggctgtcgtcagctcgtgtcgtgagatgttgggttaagtcccgcaacgagcgcaaccctcgtccttagttgctaacgattcggtcgagcactctaaggagactgccttcgtaaggaggaggaaggtggggacgacgtcaagtcatcatggcccttacgcctagggcgacacacgtgctacaatggcatatacaatgagacgcaataccgcgaggtggagcaaatctataaaatatgtcccagttcggattgttctctgcaactcgagagcatgaagccggaatcgctagtaatcgcaaatcagccatgttgcggtgaatacgttcccgggtcttgtactcaccgcccgtcacaccatgggagttgatttcactcgaagtggaaatactaaactagttatcccccacagtggaatcagcgactggggtgaagtcgtaacaaggtaaccgtaggagaacctgcggttggatcacctcctttct

SEQ ID NO: 474 - DNA, 1508 bp, Candidatus Arthromitus sp.
  SFB-mouse-Yit
agagtttgatcctggctcaggacgaacgctggcggcgtgcctaacacatgcaagttgagcggagatatatggagcttgctttatataacttagcagcgaacgggtgagtaacacgtagataatctatcctatactgggggatagcccgatgaaagttggattaataccgcatatagctatatagttgcatgattatgtagtgaaagatttattggtataggaggagtctgcggcacattagctagtaggtgaggtaaaggcttacctaggcgacgatgtgtagccggtctgagaggatgaacggccacaatggaactgagacacggtccatactcctacgggaggcagcagtggggaatattgcacaatgggggaaaccctgatgcagcaacgccgcgtgagtgaagaaggttttcggattgtaaagctctgttagcagggaagaggaaggacggtacctgcagaggaagccacggctaactacgtgccagcagccgcggtaatacgtaggtggcaagcgttgttcggaataactgggcgtaaaggatgcgtaggcggttaaacaagttatatgttaaatatataggcttaacctgtagaaagcatataaaactgtttaactagagtgcaggagaggtaagtggaattcctagtgtagcggtgaaatgcgtagagattaggaagaacaccagtggcgaaggcgacttactggactgtaactgacgctgaggcatgagagcatggggagcaaacaggattagataccctggtagtccatgctgtaaacgatgggtactaggtgtgggttgtgaataacaattcgtgccgtcgcaaacgcaataagtaccccgcctgaggagtacgatcgcaagattaaaactcaaaggaattgacggggacccgcacaagcagcggagcatgtggtttaattcgaagcaacgcgaagaaccttacctaaacttgacataccttgaattaccttgtaatgagggaagctcgcaagagcaaggatacaggtggtgcatggttgtcgtcagctcgtgtcgtgagatgttgggttaagtcccgcaacgagcgcaacccttgttgttaattgctaacaggttaagctgagcactttagcgagacagcctaggttaactaggaggaaggtggggatgacgtcaaatcatcatgccccttacgtttagggctacacacgtgctacaatggtgagaacagagagaagcaagctagtgatagtgagcaaaacttataaaactcatctcagttcggattgcaggctgaaactcgcctgtatgaagatggagttgctagtaatcgcgaatcagaatgtcgcggtgaatacgttcccgggtcttgtacacaccgcccgtcacaccatgagagttggcaacacccgaaacctgtgggctaaccatataggaggcagcagtctaaggtggggtcagtgattggggtgaagtcgtaacaaggtagccgtaggagaacctgcggctggatcacct

SEQ ID NO: 475 - DNA, 1541 bp, Candidatus Sulcia muelleri
acaatgaagagtttgatccttgctcaggataaacgctagcggagggcctaacacatgcaagtcgaggggcagcaaaaaaaatataagtttacttatattttttgttggcgaccggcaaacgggtgagtaatacatacgtaacttaccttatgctgagggatagcctgaggaaacttggattaataccttataaaacaatcttttataaagaaatattgttaaaattttagatggcataaaataggcgtatgtccgattagttagttggtaaggtaatggcttaccaagacaatgatcggtagggggcctgagagggcgtacccccacattggtactgagacacggaccaaactcctacgggaggcagcagtgaggaatattggtcaatggaggaaactctgaaccagccactccgcgtgcaggatgaaagccttatgggttgtaaactgcttttgtatatgaataaaaaattctatttttagaaaaaattgaaggtaatatacgaataagtatcggcaaactccgtgccagcagccgcggtaaaacggaggatacaagcgttatccggatttattgggtttaaagggtgcgtaggcggttttttaagtcagtagtgaaatcttaaagcttaactttaaaattgctattgatactgagagacttgagttaggttggagtagctggaatgtgtggtgtagcggtgaaatgcatagatatcacacagaacaccgatcgcgaaagcaagttactaagcctatactgacgctgaggcacgaaagcgtggggagcaaacaggattagataccctggtagtccatgccgtaaacgatgatcactaactattggttttttataattcagtggtcaagcgaaagtgataagtgatccacctgagaagtacgaccgcaaggttgaaactcaaaggaattgacgggggcccgcacaatcggtggagcatgtggtttaattcgatgatacgcgaggaaccttaccaagacttaaatgtactacgaataaattggaaacaatttagtcaaacgacggagtacaaggtgctgcatggttgtcgtcagctcgtgccgtgaggtgttaggttaagtcctttaacgagcgcaacccttatgattagttgccatcgagtaatgttggggactctaataagactgccggcgtaagccgagaggaaggtggggacgacgtcaaatcatcacggcccttacgtcttgggccacacacgtgctacaatggtcggtacaaaaggcagcgactgggtgaccagaagcaaatctctaaagccgatctcagttcggattggagtctgaaactcgactctatgaagctggaatcgctagtaatcgcgcatcagccatggcgcggtgaatacgttcccgggccttgtacacaccgcccgtcaagccatggaagttggaagtacctaaagtcggtgaccataaaaggagctgcctaaggtaagtctaataactagggctaagtcgtaacaaggtagccgtaccggaaggtgcggctggaatatctctgtt

SEQ ID NO: 476 - DNA, 1504 bp, Capnocytophaga canimorsus
agagtttgatcctggctcaggatgaacgctagcggcaggcctaacacatgcaagtcgaggggtagggtgcttcggcacttgagaccggcgcacgggtgcgtaacacgtgtacaatctaccttttgctaagggatagcccgaagaaatttggattaataccttatagtattgtttggtggcatcactaaataattaaagctctggtggcaaaagatgagtacgcgtcccattagctagttggtgtggtaacggcataccaaggctacgatgggtaggggtcctgagagggaggtcccccacactggtactgagacacggaccagactcctacgggaggcagcagtgaggaatattggacaatggtcggaagactgatccagccatgccgcgtgcaggatgacggccttatgggttgtaaactgcttttatacaggaagaataaggtctacgcgtagattgatgacggtactgtatgaataagcatcggctaactccgtgccagcagccgcggtaatacggaggatgcgagcgttatccggaatcattgggtttaaagggtccgtaggcgggcttataagtcagaggtgaaagcactgagctcaactgagtaactgcctttgaaactgtaggtcttgaatgtttgtgaagtagctggaatgtgtagtgtagcggtgaaatgcatagatattacacagaacaccgattgcgaaggcatgttactaacaaattattgacgctgatggacgaaagcgtggggagcgaacaggattagataccctggtagtccacgctgtaaacgatggatactagctgtttgggagtaattttgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccaaggtttaaatgggaaacgacgtacctagagataggtatttcttcggacgtttttcaaggtgctgcatggttgtcgtcagctcgtgccgtgaggtgtcaggttaagtcctataacgagcgcaacccctgctgttagttgctagcgagttaagtcgagcactctaacgggactgccggtgcaaaccgtgaggaaggtggggatgacgtcaaatcatcacggcccttacatcttgggctacacacgtgctacaatggccggtacagcgagcagccactgcgtgagcaggagcgaatctataaagccggtcacagttcggatcggagtctgcaactcgactccgtgaagctggaatcgctagtaatcggatatcagccatgatccggtgaatacgttcccgggccttgtacacaccgcccgtcaagccatggaagctgggggtacctgaagtcggttgccgcaaggagctgcctagggtaaaactagtgactggggctaagtcgtaacaaggtagccgtaccggaaggtgcggctggaacacct

SEQ ID NO: 477 - DNA, 1287 bp, Capnocytophaga sp.
  C1
gatgaacgctagcggcaggcctaacacatgcaagtcgagggaccggcgtacgggtgcgtaacgcgtatacaatctgcctttcactgggggatagcccgaagaaatttggattaataccccatagttaaaggtggtgaaagatgagtatgcgttctattagctagttggagaggtaacggctccccaaggcgatgatagataggggttctgagagggatgtcccccacactggtactgagatacggaccagactcctacgggaggcagcagtgaggaatattggacaatggtcggaagactgatccagccatgccgcgtgcaggatgacggcctatgggttgtaaactgcttttgtaagggaagatgacggtaccttacgaataagcatcggctaactccgtgccagcagccgcggtaatacggaggatgcgagcgttatccggaatcattgggtttaaagggtctgtaggcgggctggtaagtcagaggtgaaagcgcttagctcaactaagcaactgcctttgaaactgttggtcttgaatggttgtgaagtagttggaatgtgtagtgtagcggtgaaatgcttagatattacacagaacaccgatagcgaaggcatattactaacaatattgacgctgatggacgaaagcgtggggagcgaacaggattagataccctggtagtccacgctgtaaacgatggatactagctgtttggtattgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggtttaaatggtcaaggtgctgcatggttgtcgtcagctcgtgccgtgaggtgtcaggttaagccctataacgagcgcaacccctgccattagttgctaacgatcgagccctctaatgggactgccggtgcaaaccggaggaaggtggggatgacgtcaaatcatcacggcccttacatcttgggctacacacgtgctacaatggccgtcagagagcagccactgcgtgagcaggcgcgaatctatacggtcacagttcggacggagtctgcaactcgactccggaagctggaatcgctagtaatcggatatcagccatgatccggtgaatacgttcccgggccttgtacacaccgcccgtcaagccatggaagctgggagtacctgaagacggttgctgtttagggtaaaactagtgactggggc

SEQ ID NO: 478 - DNA, 1509 bp, Capnocytophaga gingivalis
tgaagagtttgatcctggctcaggatgaacgctagcggcaggcctaacacatgcaagtcgagggagaagccctttcgggggcagaaaccggcgcacgggtgcgtaacgcgtatgcaacctacctttcacagggggatagcccgaagaaatttggattaataccccataatattattggatggcatcatttgataattaaaactgcggtggtgaaagatgggcatgcgtcctattagctagttggagtggtaacggcaccccaaggctacgataggtaggggtcctgagagggagatcccccacactggtactgagacagggaccagactcctacgggaggcagcagtgaggaatattggtcaatggtcggaagactgaaccagccatgccgcgtgcaggaagaatgccttatgggttgtaaactgcttttatatgggaagaataaggtgtacgtgtacattgatgacggtaccatatgaataagcatcggctaactccgtgccagcagccgcggtaatacggagggtgcgagcgttattcggaatcattgggtttaaagggtctgtaggcgggctattaagtcagaggtgaaaggtttcagcttaactgagaaattgcctttgatactggtagtcttgaatatctgtgaagttcttggaatgtgtagtgtagcggtgaaatgcttagatattacacagaacaccgattgcgaaggcaggggactaacagacaattgacgctgagagacgaaagcgtggggagcgaacaggattagataccctggtagtccacgctgtaaacgatggatactagctgtttggcgcaagctgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccaaggtttaaatggggactgacaggtgtagagatacgcccttcttcggacagttttcaaggtgctgcatggttgtcgtcagctcgtgccgtgaggtgtcaggttaagccctataacgagcgcaacccctattgttagttaccagcacgtaaaggtggggactctagcaagactgccggtgtaaaccgtgaggaaggtggggatgacgtcaaatcatcacggcccttacatcttgggctacacacgtgctacaatggtcgttacagagagcagccactgcgcgagcaggagcgaatctataaagacgatcacagttcggatcggagtctgcaactcgactccgtgaagctggaatcgctagtaatcggatatcagccatgatccggtgaatacgttcccgggccttgtacacaccgcccgtcaagccatggaagctgggagtacctgaagtcggtcaccgcaaggagctgcctagggtaaaaccagtgactggggctaagtcgtaacaaggtagccgtaccggaaggtgtggctggaacacctcctt

SEQ ID NO: 479 - DNA, 1417 bp, Capnocytophaga granulosa
  modified_base (28)..(28): a, c, t, g, unknown or other
aggcctaacacatgcaagtcgagggagnaagcccttcggggtagaaaccggcgcacgggtgcgtaacgcgtatgcaacctacctttcacagggggatagcccgaagaaatttggattaataccccataatattattggatggcatcatttgataattaaaattacgatggtgaaagatgggcatgcgtcctattagctagttggagtggtaacggcaccccaaggctacgataggtaggggtcctgagagggagatcccccacactggtactgagacagggaccagactcctacgggaggcagcagtgaggaatattggtcaatggtcggaagactgaaccagccatgccgcgtgcaggaagaatgccttatgggttgtaaactgcttttatatgggaagaataaggagtacgtgtactttgatgacggtaccatatgaataagcatcggctaactccgtgccagcagccgcggtaatacggaggatgcgagcgttattcggaatcattgggtttaaagggtctgtaggcgggctattaagtcaggggtgaaaggtttcagcttaactgagaaattgcctttgatactggtagtcttgaaaatctgtgaagttcttggaatgtgtagtgtagcggtgaaatgcttagatattacacagaacaccgattgcgaaggcaggggactaacagacgattgacgctgagagacgaaagcgtggggagcgaacaggattagataccctggtagtccaccctgtaaacgatggatactagctgtttggagtaatttgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccaaggtttaaatggagactgacaggggcagagatgcctttttcttcggacagttttcaaggtgctgcatggttgtcgtcagctcgtgccgtgaggtgtcaggttaagtcctataacgagcgcaacccctattgttagttaccagcacgtagtggtggggactctagcaagactgccggtgtaaaccgtgaggaaggtggggatgacgtcaaatcatcacggcccttacatcttgggctacacacgtgctacaatggtcgttacagagagcagccactgcgcgagcaggagcgaatctataaagacggtcacagttcggatcggagtctgcaactcgactccgtgaagctggaatcgctagtaatcggatatcagccatgatccggtgaatacgttcccgggccttgtacacaccgcccgtcaagccatggaagctgggagtacctgaagtcggttgccgcaaggagctgcctagggtaaaaccagtgactgggg

SEQ ID NO: 480 - DNA, 1518 bp, Capnocytophaga ochracea
acgatgaagagtttgatcctggctcaggatgaacgctagcggcaggcctaacacatgcaagtcgagggggaagttactttcgggtaacagagaccggcgtacgggtgcgtaacgcgtatacaatctgcctttcactgggggatagcccgaagaaatttggattaataccccatagtatatagggacggcatcgtttttatattaaagctctggtggtgaaagatgagtatgcgttctattagctagttggagaggtaacggctccccaaggctatgatagataggggttctgagagggatgtcccccacactggtactgagatacggaccagactcctacgggaggcagcagtgaggaatattggacaatggtcggaagactgatccagccatgccgcgtgcaggatgactgccttatgggttgtaaactgcttttgtaagggaagaataagggctacgcgtagtttgatgacggtaccttacgaataagcatcggctaactccgtgccagcagccgcggtaatacggaggatgcgagcgttatccggaatcattgggtttaaagggtccgtaggcgggctaataagtcaggggtgaaatcgttcagctcaactgagcaactgcctttgaaactgttggtcttgaatggttgtgaagtagttggaatgtgtagtgtagcggtgaaatgcttagatattacacagaacaccgatagcgaaggcatattactaacaattaattgacgctgatggacgaaagcgtggggagcgaacaggattagataccctggtagtccacgctgtaaacgatggatactagctgtttggagtaatctgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggtttaaatggggactgacagaggtagagatacctttttcttcggacagttttcaaggtgctgcatggttgtcgtcagctcgtgccgtgaggtgtcaggttaagtcctataacgagcgcaacccctgccattagttgctaacgagtaaggtcgagccctctaatgggactgccggtgcaaaccgtgaggaaggtggggatgacgtcaaatcatcacggcccttacatcttgggctacacacgtgctacaatggccgttacagagagcagccactgcgtgagcaggcgcgaatctataaagacggtcacagttcggatcggagtctgcaactcgactccgtgaagctggaatcgctagtaatcggatatcagccatgatccggtgaatacgttcccgggccttgtacacaccgcccgtcaagccatggaagctgggggtacctgaagacggttaccgcgaggagctgtttagggtaaaactagtgactggggctaagtcgtaacaaggtagccgtaccggaaggtgcggctggaacacctcctttct

SEQ ID NO: 481 - DNA, 1405 bp, Capnocytophaga sp.
  GEJ8
gcctacacatgcaagtcgagggggaagttactttcgggtaacagagaccggcgtacgggtgcgtaacgcgtatacaatctgcctttcactgggggatagcccgaagaaatttggattaataccccatagtatagtaatacggcatcgtgatactattaaagcttaggtggtgaaagatgagtatgcgttctattagttagttggagaggtaacggctccccaaggcgatgatagataggggttctgagagggatgtcccccacactggtactgagatacggaccagactcctacgggaggcagcagtgaggaatattggacaatggtcggaagactgatccagccatgccgcgtgcaggatgaaggtcttatggattgtaaactgcttttgtaagggaagaataagggctacgtgtagtttgatgacggtaccttacgaataagcatcggctaactccgtgccagcagccgcggtaatacggaggatgcgagcgttatccggaatcattgggtttaaagggtctgtaggcgggctggtaagtcagaggtgaaagcgctcagctcaactgaggcaactgcctttgaaactgttggtcttgaatggttgtgaaagtagttggaatgtgtagtgtagcggtgaaatgcttagatattacacagaacaccgatagcgaaggcatattactaacaattgattgacgctgatggacgaaagcgtggggagcgaacaggattagataccctggtagtccacgctgtaaacgatggatactagctgtttggtcgcgagtttgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggtttaaatggggactgacaggggtagagatacccttttcttcggacagttttcaaggtgctgcatggttgtcgtcagctcgtgccgtgaggtgtcaggttaagtcctataacgagcgcaacccctgccattagttgctaacgagtaaggtcgagccctctaatgggactgccggtgcaaaccgagaggaaggtggggatgacgtcaaatcatcacggcccttacatcttgggctacacacgtgctacaatggccgttacagagagcagccactgcgtgagcaggcgcgaatctataaagacggtcacagttcggatcggagtctgcaactcgactccgtgaagctggaatcgctagtaatcggatatcagccatgatccggtgaatacgttcccgggccttgtacacaccgcccgtcaagccatggaagctgggagtacctgaagacggttaccgcaaggagctgttaggtaaa

SEQ ID NO: 482 - DNA, 1450 bp, Capnocytophaga sp.
  S1b
  modified_base (31)..(31): a, c, t, g, unknown or other
  modified_base (83)..(83): a, c, t, g, unknown or other
  modified_base (376)..(376): a, c, t, g, unknown or other
  modified_base (409)..(409): a, c, t, g, unknown or other
  modified_base (449)..(449): a, c, t, g, unknown or other
  modified_base (455)..(455): a, c, t, g, unknown or other
  modified_base (513)..(514): a, c, t, g, unknown or other
  modified_base (523)..(523): a, c, t, g, unknown or other
  modified_base (772)..(772): a, c, t, g, unknown or other
  modified_base (1001)..(1003): a, c, t, g, unknown or other
  modified_base (1062)..(1062): a, c, t, g, unknown or other
  modified_base (1077)..(1077): a, c, t, g, unknown or other
  modified_base (1113)..(1113): a, c, t, g, unknown or other
  modified_base (1215)..(1215): a, c, t, g, unknown or other
  modified_base (1419)..(1419): a, c, t, g, unknown or other
  modified_base (1441)..(1441): a, c, t, g, unknown or other
acgatgaagagtttgatcctggctcaggatnaacgctagcggcaggcctaacacatgcaagtcgaggagaagccttcgggctnaraccggcgyacgggtgcgtaacgcgtatacaatctgcctttcactgggggatagcccgaagaaatttggattaataccccatagtatagtaatacggcatcgtgatactattaaagcttaggtggtgaaagatgagtatgcgttctattagctagttggagaggtaacggctccccaaggctatgatagataggggttctgagagggatgtcccccacactggtactgagatacggaccagactcctacgggaggcagcagtgaggaatattggacaatggtcggaagactnatccagccatgccgcgtgcaggatgaaggtctnatggattgtaaactgcttttgtaagggaagaataaggctncgcgtngtttgatgacggtaccttacgaataagcatcggctaactccgtgccagcagccgcggnnatacggagnatgcgagcgttatccggaatcattgggtttaaagggtctgtaggcgggcttgtaagtcagaggtgaaagcgctcagctcaactgagcaactgcctttgaaactgttggtcttgaatggttgtgaagtagttggaatgtgtagtgtagcggtgaaatgcttagatattacacagaacaccgatagcgaaggcatattactaacaattaattgacgctgatggacgaaagcgtggggagcgaacaggattngataccctggtagtccacgctgtaaacgatggatactagctgtttggtttaaggattgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggtttaaatggrgactgacaggggtagagatacgnnnttcttcggacagttttcaaggtgctgcatggttgtcgtcagctcgtgccgtgaggtgtnaggttaagtcctatnacgagcgcaacccctgccattagttgctaacgagtnaagtcgagccctctaatgggactgccggtgcaaaccgtgaggaaggtggggatgacgtcaaatcatcacggcccttacatcttgggctacacacgtgctacnatggccgttacagagagcagccactgcgtgagcaggcgcgaatctataaagacggtcacagttcggatcggagtctgcaactcgactccgtgaagctggaatcgctagtaatcggatatcagccatgatccggtgaatacgttcccgggccttgtacacaccgcccgtcaagccatggaagctgggagtacctgaagacggttnccgcaaggagctgtttagggtnaaactagtg

SEQ ID NO: 483 - DNA, 1442 bp, Capnocytophaga sp.
  oral clone AH015
  modified_base (537)..(537): a, c, t, g, unknown or other
ggctcaggatgaacgctagcggcaggcctaacacatgcaagtcgagggagaagcctttcggggcagaaaccggcgcacgggtgcgtaacgcgtatgcaacctacctttcacagggggatagcccgaagaaatttggattaataccccataatattgttggatggcatcatctgataattaaaactgtggtggtgaaagatgggcatgcgtcctattagctagttggagtggtaacggcaccccaaggctatgataggtaggggtcctgagagggagatcccccacactggtactgagacagggaccagactcctacgggaggcagcagtgaggaatattggtcaatggtcggaagactgaaccagccatgccgcgtgcaggaagaatgccttatgggttgtaaactgcttttatatgggaagaataaggtgtaacgtgtacattgatgacggtaccatatgaataagcatcggctaactccgtgccagcagccgcggtaatacggaggatgcgagcgttattcggaatcattgggtntaaagggtctgtaggcgggctattaagtcaggggtgaaaggtttcagcttaactgagaaattgcctttgatactggtagtcttgaatatctgtgaagttcttggaatgtgtagtgtagcggtgaaatgcttagatattacacagaacaccgattgcggaggcaggggactaacagacgattgacgctgagagacgaaagcgtggggagcgaacaggattmgataccctggtagtccacgctgtaaacgatggatactagctgtttggagaaatttgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccaaggtytaaatggagactgacaggggcagagatgcctttttcttcggacagttttcaaggtgctgcatggttgtcgtcagctcgtgccgtkaggtgtcaggttaagtcctataacgagcgcaacccctattgttagttaccagcacgtaatggtggggactcwagcaagactgccggtgtaaaccgtgaggaaggtggggatgacgtcaaatcatcacggcccttacatcttgggctacacacgtgctacaatggtcgttacagagagcagscactgcgcgagcaggagcgaatctataaagacggtcacagttcggatcggagtctgcaactcgactccgtgaagctggaatcgctagtaatcggatatcagccatgatccggtgaatacgttcccgggccttgtacacaccgcccgtcaagccatggwagctgggggtacctgaagtcggttgccgcaaggagctgcctagggtaaaaccagtgactggggct

SEQ ID NO: 484 - DNA, 1529 bp, Capnocytophaga sp.
  oral clone ASCH05
  modified_base (974)..(974): a, c, t, g, unknown or other
  modified_base (1016)..(1016): a, c, t, g, unknown or other
gagagtttgatcatggctcaggatgaacgctagctacaggcttaacacatgcaagtcgaggggagaggttaccttcgggtaactgaaaccggcgcacgggtgcgtaacgcgtatacaatctgcctttcacatagggatagcccgaagaaatttggattaatacctaatggtatataagagcggcatcgtttttatattaaagctacggtggtgaaagatgagtatgcgttctattagctagttggagaggtaacggctccccaaggcgacgatagataggggttctgagagggatgtcccccacactggtactgagatacggaccagactcctacgggaggcagcagtgaggaatattggacaatggtcggaagactgatccagccatgccgcgtgcaggatgaaggtcctatggattgtaaactgcttttgtaagggaagaataaggagtacgtgtactttgatgacggtaccttacgaataagcatcggctaactccgtgcccgcagccgcggtaatacggaggatgcgagcgttatccggaatcattgggtttaaagggtccgtaggcgggctgataagtcagaggtgaaagcgcttagctcaactaagcaactgcctttgaaactgtcagtcttgaatgattgtgaagtagttggaatgtgtagtgtagcggtgaaatgcttagatatgacgaagaactccgattgcgaaggcagcttacgggagcacaactgacgctgaagctcgaaggtgcgggtatcaaacaggattagataccctggtagtccgcacagtaaacgctggatgcccgctgttggttcattagagtcagcggccaagcgaaagtgataagtatcccacctgggggagtacgcacgcaagtgtgaaactcaaaggaattgacgggggcccgcacaagccggaggaacatgtggtttaattcgatgatacgcgaggaaccttaccaaggngttgaatgggaactgacagaggtagagatgaagaggcccttncggacagttttcaaggtgctgcatggttgtcgtcagctcttgccgtgaggtgtcggcttaagtgccataacgagcgcaaccccttttcttagttgccatcaggtcatgctgggcactctgggaatactgccaccgtaaggtgtgaggaaggtggggatgacgtcaaatcatcacggcccttacatcttgggctacacacgtgctacaatgggctttaatagaggggagcgaagccgcgaggtggagcaaaccccagaaacaagctctcagttcggatcggagtctgcaactcgactccgtgaagctggaatcgctagtaatcggatatcagccatgatccggtgaatacgttcccgggccttgtacacaccgcccgtcacacaacgaaagtcggaagtacccaaagccggtggggtaaccttcgggagccagccgtctaaggtaaagtcgatgattggggtgaagtcgtaacaaggtagccgtatcggaaggtgcggctggaacacctccttc

SEQ ID NO: 485 - DNA, 1357 bp, Capnocytophaga sp.
  oral clone ID062
gagtttgattctggctcaggatgaacgctagcggcaggcctaacacatgcaagtcgagggaccggcgcacgggtgcgtaacgcgtatataatctaccttatacagagggatagcccgaagaaatttggattaatacttcatagttaaaggcggtataagatgagtatgcgtcctattagctagttggtatggtaacggcataccaaggctacgataggtaggggtcctgagagggagatcccccacactggtactgagacacggaccagactcctacgggaggcagcagtgaggaatattggtcaatgggcgagagcctgaaccagccaagtcgcgtgaaggatgactgtctatggattgtaaacttcttttatacgggaatatgcatgtaccgtatgaataagcatcggctaactccgtgccagcagccgcggtaatacggaggatgcgagcgttatccggaatcattgggtttaaagggtccgtaggcgggctgataagtcagaggtgaaagcgcttagctcaactaagcaactgcctttgaaactgtcagtcttgaatgattgtgaagtagttggaatgtgtagtgtagcggtgaaatgcttagatattacacagaacaccgatagcgaaggcatattactaacaatatcgacgctgatggacgaaagcgtggggagcgaacaggattagataccctggtagtccacgctgtaaacgatggatactagctgtttggatatgagtggctaagcgaaagtgataagtatcccacctggggagtacgcacgcaagtgtgaaactcaaaggaattgacgggggcccgctcaagcggtggagcatgtggtttaattcgatgatacgcgaggaaccttaccaaggtttaaatggtcaaggtgctgcatggttgtcgtcagctcgtgccgtgaggtgtcaggttaagtcctataacgagcgcaacccctgccattagttgctaacgatcgagccctctagtgggactgccggtgcaaaccggaggaaggtggggatgacgtcaaatcatcacggcccttacatcttgggctacacacgtgctacaatggccgtcagagagcagccactgcgcgagcaggagcgaatctatacggtcacagttcggacggagtctgcaactcgactccggaagctggaatcgctagtaatcggatatcaaccatgatccggtgaatacgttcccgggccttgtacacaccgcccgtcaagccatggaagctgggggtacctgaaggcggtcgctgattagggtaaaactagtgactggggctaagtcgtaacaaggtagccgtaccggaaggtgcgggtggatcacctcctt

SEQ ID NO: 486 - DNA, 1509 bp, Capnocytophaga sp.
  oral strain A47ROY
  modified_base (888)..(888): a, c, t, g, unknown or other
  modified_base (895)..(896): a, c, t, g, unknown or other
  modified_base (955)..(955): a, c, t, g, unknown or other
  modified_base (979)..(979): a, c, t, g, unknown or other
  modified_base (999)..(999): a, c, t, g, unknown or other
  modified_base (1016)..(1016): a, c, t, g, unknown or other
  modified_base (1019)..(1019): a, c, t, g, unknown or other
agagtttgatcctggctcaggatgaacgctagcggcaggcctaacacatgcaagtcgagggggaagttactttcgggtaactgagaccggcgtacgggtgcgtaacgcgtatacaatctgcctttcactgggggatagcccgaagaaatttggattaataccccatagtatagtagtgtggcatcacacaactattaaagccttggtggtgaaagatgagtatgcgttctattagctagttggagaggtaacggctccccaaggctacgatagataggggttctgagagggatgtcccccacactggtactgagatacggaccagactcctacgggaggcagcagtgaggaatattggacaatggtcggaagactgatccagccatgccgcgtgcaggatgacggccttatgggttgtaaactgcttttgtaagggaagaataaggagtacgtgtactttgatgacggtaccttacgaataagcatcggctaactccgtgccagcagccgcggtaatacggaggatgcgagcgttatccggaatcattgggtttaaagggtccgtaggcgggctaataagtcagaggtgaaagcgcttagctcaactaagcaactgcctttgaaactgttggtcttgaatggttgtgaagtagttggaatgtgtagtgtagcggtgaaatgcttagatattacacagaacaccgatagcgaaggcatattactaacaattaattgacgctgatggacgaaagcgtggggagcgaacaggattagataccctggtagtccacgctgtaaacgatggatactagctgtttggtctaaggattgagtggctaagcgaaagtgataagtatcccacctggggagtacgttcgcaagaatganactcaanngaattgacgggggcccgcacaagcggtggagcatgtggtttaattcgatgatacgcgangaaccttcccagggtttaaatggngactgacagatgtagagatncctccttcttcggacanttntcaaggtgctgcatggttgtcgtcagctcgtgccgtgaggtgtcaggttaagtcctataacgagcgcaacccctgccattagttgctaacgagtaaggtcgagccctctaatgggactgccggtgcaaaccgtgaggaaggtggggatgacgtcaaatcatcacggcctttacatcttgggctacacacgtgctacaatggccgttacagagagcagccactgcgtgagcaggcgcgaatctataaagacggtcacagttcggatcggagtctgcaactcgactccgtgaagctggaatcgctagtaatcggatatcagccatgatccggtgaatacgttcccgggccttgtacacaccgcccgtcaagccatggaagctgggagtacctgaagacggtcaccgcaaggagctgtttagggtaaaactagtgactggggctaagtcgtaacaaggtagccgtaccggaaggtgcggctggatcacctccc

SEQ ID NO: 487 - DNA, 1463 bp, Capnocytophaga sp.
  oral strain S3
  modified_base (33)..(33): a, c, t, g, unknown or other
  modified_base (520)..(520): a, c, t, g, unknown or other
  modified_base (1008)..(1008): a, c, t, g, unknown or other
taacgatgaagagtttgatcctggctcaggatnaacgctagcggcaggcctaacacatgcaagtcgagggagaagcccttcggggcagaaaccggcgcacgggtgcgtaacgcgtatgcaacctacctttcacagggggatagcccgaagaaatttggattaataccccataatattgttggatggcatcattttgcaattaaaactgcggtggtgagagatgggcatgcgtcctattagctagttggagtggtaacggcaccccaaggctacgataggtaggggtcctgagagggagatcccccacactggtactgagacagggaccagactcctacgggaggcagcagtgaggaatattggtcaatggtcggaagactgaaccagccatgccgcgtgcaggaagaatgccttatgggttgtaaactgcttttatatgggaagaataaggtgtacgagtacattgatgacggtaccatatgaataagcatcggctaactccgtgccagcagccgcggtnatacggaggatgcgagcgttattcggaatcattgggtttaaagggtctgtaggcgggctattaagtcaggggtgaaaggtttcagcttaactgagaaattgcctttgatactggtagtcttgaatatctgtgaagttcttggaatgtgtagtgtagcggtgaaatgcttagatattacacagaacaccgattgcgaaggcaggggactaacagacaattgacgctgagagacgaaagcgtggggagcgaacaggattagataccctggtagtccacgctgtaaacgatggatactagctgtttgatgataagttgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccaaggtttaaatggggactgacaggtgtagagatacgccnttcttcggacagttttcaaggtgctgcatggttgtcgtcagctcgtgccgtgaggtgtcaggttaagtcctataacgagcgcaacccctattgttagttaccagcacgtagtggtggggactctagcaagactgccggtgtaaaccgtgaggaaggtggggatgacgtcaaatcatcacggcccttacatcttgggctacacacgtgctacaatggtcgttacagagagcagccactgcgtgagcaggagcgaatctataaagacgatcacagttcggatcggagtctgcaactcgactccgtgaagctggaatcgctagtaatcggatatcagccatgatccggtgaatacgttcccgggccttgtacacaccgcccgtcaagccatggaagctgggagtacctgaagtcggtgaccgcaaggagctgcctagggtaaaaccagtgactggggc

SEQ ID NO: 488 - DNA, 1516 bp, Capnocytophaga sp.
  oral taxon 338
acgatgaagagtttgatcctggctcaggatgaacgctagcggcaggcctaacacatgcaagtcgagggagaagcccttcggggcagaaaccggcgcacgggtgcgtaacgcgtatgcaacctacctttcacagggggatagcccggagaaatttggattaatatcccataatattgttggatggcatcatttggcaattaaagttacgatggtggaagatgggcatgcgtcctattagctagttggcgaggtaacggctcgccaaggcgacgataggtaggggtcctgagagggagatcccccacactggtactgagacagggaccagactcctacgggaggcagcagtgaggaatattggtcaatggtcggaagactgaaccagccatgccgcgtgcaggaaggcggccttatgggttgtaaactgcttttatatgggaagaataaggagtacgtgtactttgatgacggtaccatatgaataagcatcggctaactccgtgccagcagccgcggtaatacggaggatgcgagcgttattcggaatcattgggtttaaagggtctgtaggcgggctattaagtcaggggtgaaatatttcagcttaactgggaaattgcctttgatactggtagtcttgaatatttgtgaagtttttggaatgtgtagtgtagcggtgaaatgcatagatattacacagaacaccgattgcggaggcaggggactaacaaataattgacgctgagagacgagagcgtggggagcgaacaggattagataccctggtagtccacgctgtaaacgatggatactagctgtttggtaggaatattgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccaaggtttaaatggtgactgacgtacctagagatgggtatttcttcggacagttatcaaggtgctgcatggttgtcgtcagctcgtgccgtgaggtgtcaggttaagtcctataacgagcgcaacccctattgatagttaccagcacgtaaaggtggggactctattgagactgccggtgtaaaccgtgaggaaggtggggatgacgtcaaatcatcacggcccttacatcttgggctacacacgtgctacaatggtcgttacagagagcagctactgcgtgagcaggtgcgaatcttaaaagacggtcacagttcggatcggagtctgcaactcgactccgtgaagctggaatcgctagtaatcgcatatcagccatgatgcggtgaatacgttcccgggccttgtacacaccgcccgtcaagccatggaagctgggagtacctgaagttggttaccgcaaggagctacctagggtaaaaccagtgactggggctaagtcgtaacaaggtagccgtaccggaaggtgtggctggaacacctcctttct

SEQ ID NO: 489 - DNA, 1518 bp, Capnocytophaga sputigena
acgatgaagagtttgatcctggctcaggatgaacgctagcggcaggcctaacacatgcaagtcgagggagaggttaccttcgggtaaccaaaaccggcgcacgggtgcgtaacgcgtatacaatctgcctttcacatagggatagcccgaagaaatttggattaatacctaatggtatataggagcggcatcgtttttatattaaagctacggtggtgaaagatgagtatgcgttctattagctagttggagaggtaacggctccccaaggcgacgatagataggggttctgagagggatgtcccccacactggtactgagatacggaccagactcctacgggaggcagcagtgaggaatattggacaatggtcggaagactgatccagccatgccgcgtgcaggatgaaggtcctatggattgtaaactgcttttgtaagggaagaataaggagtacgtgtactttgatgacggtaccttacgaataagcatcggctaactccgtgccagcagccgcggtaatacggaggatgcgagcgttatccggaatcattgggtttaaagggtccgtaggcgggctgataagtcagaggtgaaagcgcttagctcaactaagcaactgcctttgaaactgtcagtcttgaatgattgtgaagtagttggaatgtgtagtgtagcggtgaaatgcttagatattacacagaacaccgatagcgaaggcatattactaacaatttattgacgctgatggacgaaagcgtggggagcgaacaggattagataccctggtagtccacgctgtaaacgatggatactagctgtttggagcaatctgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccaaggtttaaatgggaactgacagaggtagagatacctccttcttcggacagttttcaaggtgctgcatggttgtcgtcagctcgtgccgtgaggtgtcaggttaagtcctataacgagcgcaacccctgccattagttgctaacgagtcaagtcgagccctctagtgggactgccggtgcaaaccgtgaggaaggtggggatgacgtcaaatcatcacggcccttacatcttgggctacacacgtgctacaatggccgttacagagagcagccactgcgcgagcaggagcgaatctataaagacggtcacagttcggatcggagtctgcaactcgactccgtgaagctggaatcgctagtaatcggatatcagccatgatccggtgaatacgttcccgggccttgtacacaccgcccgtcaagccatggaagctgggggtacctgaagacggtcaccgcgaggagctgtttagggtaaaactagtgactggggctaagtcgtaacaaggtagccgtaccggaaggtgcggctggaacacctcctttct

SEQ ID NO: 490 - DNA, 1534 bp, Cardiobacterium hominis
gaactgaagagtttgattctggctcagattgaacgctggcggcatgcttaacacatgcaagtcgaacggaaacgatggagcttgctccaggcgtcgagtggcggacgggtgagtaacgcatgggaatctgccttttgctgggggataacgtagggaaacttacgctaataccgcataagacctaagggtgaaagcgggggaccgaaaggcctcgcggcaagagatgagcccatgttggattagctagttggtggggtaaaggcctaccaaggcgacgatccatagctggtctgagaggatgatcagccacactgggactgagacacggcccagactcctacgggaggcagcagtggggaatattggacaatggggggaaccctgatccagcaatgccgcgtgtgtgaagaaggccttcgggttgtaaagcactttcagtagggaggaaaggtgcgtagttaatacctgcgcaattgacgttacctacagaagaagcaccggctaactccgtgccagcagccgcggtaatacggagggtgcgagcgttattcggaattactgggcgtaaagcgcacgcaggcggttgcccaagtcagatgtgaaagccccgggcttaacctgggaactgcatttgaaactgggcgactagagtatgaaagaggaaagcggaatttccagtgtagcagtgaaatgcgtagatattggaaggaacaccgatggcgaaggcagctttctgggtcgatactgacgctcatgtgcgaaagcgtggggagcaaacaggattagataccctggtagtccacgccctaaacgatgtcaactaggcgtcgggttgttaaagactcggtgccggagctaacgcattaagttgaccgcctggggagtacggccgcaaggttgaaactcaaagaaattgacggggacccgcacaagcggtggagcatgtggtttaattcgatgcaacgcgaagaaccttaccaggccttgacatcctaggaacttggcagagatgccttggtgccttcgggaacctagagacaggtgttgcatggctgtcgtcagctcgtgtcgtgagatgttgggttaagtcccgcaacgagcgcaacccttatccttacttgccagcactttgggtgggaactgtaaggagactgccggtgacaaaccggaggaaggtggggatgacgtcaagtcatcatggcccttacggcctgggctacacacgtgctacaatggtcggtacagacggtagcgaagccgcgaggtggagccaatctgagaaagccgatcgtagtccggattgcagtctgcaactcgactgcatgaagtcggaatcgctagtaatcgcgaatcagcatgtcgcggtgaatacgttcccgggtcttgtacacactgcccgtcacaccatgggagtttgttgcaccagaagcaggtagcttaacttaggagggcgcttgccacggtgtggccgatgactggggtgaagtcgtaacaaggtaaccgtaggggaacctgcggttggatcacctccttt

SEQ ID NO: 491 - DNA, 1493 bp, Cardiobacterium valvarum
gcgtgcttaacacatgcaagtcgaacggaaacgacggagcttgctccgggcgtcgagtggcggacgggtgagtaatgcatgggaatctgccttttgctgggggataacgtagggaaacttacgctaataccgcataagacctgagggtgaaagtgggggaccgttaaggcctcacggcagaagatgagcccatgtcggattagctagttggtggggtaaaggcctaccaaggcgacgatccgtagctggtctgagaggatgatcagccacactgggactgagacacggcccagactcctacgggaggcagcagtggggaatattggacaatgggggcaaccctgatccagcaatgccgcgtgtgtgaagaaggccttcgggttgtaaagcactttcagcagggaggaaagcatcatggttaacacccatggtagtgacgttacctgcagaagaagcaccggctaactccgtgccagcagccgcggtaatacggagggtgcaagcgttattcggaattactgggcgtaaagcgcacgcaggcggctacctaagtcagatgtgaaagccccgggcttaacctgggaactgcatttgaaactgggcagctagagtatgaaagaggaaagcggaatttccagtgtagcagtgaaatgcgtagatattggaaggaacaccgatggcgaaggcagctttctgggtcgatactgacgctcatgtgcgaaagcgtggggagcaaacaggattagataccctggtagtccacgccctaaacgatgtcaactaggcgtcgggttgtatagactcggtgccgcagctaacgcattaagttgaccgcctggggagtacggccgcaaggttgaaactcaaagaaattgacggggacccgcacaagcggtggagcatgtggtttaattcgatgcaacgcgaagaaccttaccaggccttgacatccagagaacttagcagagatgctttggtgccttcgggaactctgagacaggtgttgcatggctgtcgtcagctcgtgtcgtgagatgttgggttaagtcccgcaacgagcgcaacccttatccttacttgccagcacttagggtgggaactgtaaggagactgccggtgacaagccggaggaaggtggggatgacgtcaagtcatcatggcccttacggcctgggctacacacgtgctacaatggtcggtacagacggtagcgaagccgcgaggtggagccaatctgagaaagccgatcgtagtccggattgcagtctgcaactcgactgcatgaagtcggaatcgctagtaatcgcgaatcagcatgtcgcggtgaatacgttcccgggtcttgtacacactgcccgtcacaccatgggagtttgttgcaccagaagcaggtagcttaacgaaagagggcgcttgccacggtgtggccgatgactggggtgaagtcgtaacaaggtaaccgtaggggaacctgcggttggatcacctcctac

SEQ ID NO: 492 - DNA, 1503 bp, Carnobacterium divergens
  modified_base (1)..(1): a, c, t, g, unknown or other
  modified_base (98)..(99): a, c, t, g, unknown or other
  modified_base (234)..(234): a, c, t, g, unknown or other
  modified_base (250)..(250): a, c, t, g, unknown or other
  modified_base (349)..(350): a, c, t, g, unknown or other
  modified_base (541)..(541): a, c, t, g, unknown or other
  modified_base (560)..(560): a, c, t, g, unknown or other
  modified_base (642)..(643): a, c, t, g, unknown or other
  modified_base (777)..(780): a, c, t, g, unknown or other
  modified_base (947)..(947): a, c, t, g, unknown or other
  modified_base (981)..(982): a, c, t, g, unknown or other
  modified_base (1037)..(1038): a, c, t, g, unknown or other
  modified_base (1043)..(1043): a, c, t, g, unknown or other
  modified_base (1067)..(1067): a, c, t, g, unknown or other
  modified_base (1114)..(1114): a, c, t, g, unknown or other
  modified_base (1401)..(1401): a, c, t, g, unknown or other
  modified_base (1424)..(1424): a, c, t, g, unknown or other
  modified_base (1500)..(1500): a, c, t, g, unknown or other
nttatatgagagtttgatcctggctcaggacgaacgctggcggcatgcctaatacatgcaagtcgaacgcacgaagttgaaaagcttgcttttcgatnnaagtaagtggcggacgggtgagtaacacgtgggtaacctgcccataagagggggataacattcggaaacggatgctaataccgcatatttcaagtgaccgcatggtcgcttgatgaaaggtggcttcggctaccncttatggatggacccncggtgcattagttagttggtgaggtaatggctcaccaagaccatgatgcatagccgacctgagagggtgatcggccacactgggactgagacacggccnngactcctacgggaggcagcagtagggaatcttccgcaatggacgaaagtctgacggagcaatgccgcgtgagtgaagaaggttttcggatcgtaaaactctgttgttagagaagaacaaggatgagagtaactgctcatcccctgacggtatctaaccagaaagccacggctaactacgtgccagcagccncggtaatacgtaggtggcnagcgttgtccggatttattgggcgtaaagcgagcgcaggcggttctttaagtctgatgtgaaagcccccggctcaaccgggnngggtcattggaaactggagaacttgagtgcagaagaggagagtggaattccatgtgtagcggtgaaatgcgtagatatatggaggaacaccagtggcgaaggcgactctctggtctgtaactgacgctgaggcnnnnaagcgtggggagcaaacaggattagataccctggtagtccacgctgtaaacgatgagtgctaagtgttggagggtttccgcccttcagtgctgcagctaacgcattaagcactccgcctggggagtacgaccgcaaggttgaaactcaaaggaattgacggggaccngcacaagcggtggagcatgtggtttaattcgaannaacgcgaagaaccttaccaggtcttgacatcctttgaccactcgagagatcgagnnttccnttcggggacaaagtgacaggtggngcatggttgtcgtcagctcgtgtcgtgagatgttgggttaagtcccncaacgagcgcaacccttattactagttgccagcattcagttgggcactctagtgagactgccggtgacaaaccggaggaaggtggggatgacgtcaaatcatcatgccccttatgacctgggctacacacgtgctacaatggatggtacaacgagtcgcgaagtcgtgaggccaagctaatctcttaaagccattctcagttcggattgtaggctgcaactcgcctacatgaagccggaatcgctagtaatcgcggatcagaacgccgcggtgaatacgttcccggntcttgtacacaccgcccgtcacnccacgagagtttgtaacacccgaagccggtgaggtaaccttttaggagccagccgtctaaggtgggatagataatnggg

SEQ ID NO: 493 - DNA, 1547 bp, Carnobacterium maltaromaticum
agagtttgatcctggctcaggacgaacgctggcggcgtgcctaatacatgcaagtcgaacgcacgaagttgaagagcttgctctttaaccaagtgagtggcggacgggtgagtaacacgtgggtaacctgcccattagagggggataacattcggaaacggatgctaataccgcatagtttcaggaatcgcatgattcttgaaggaaaggtggcttcggctaccactaatggatggacccgcggcgtattatctagttggtgaggtaatggctcaccaaggcaatgatacgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttaaagaagaacaaggatgagagtaactgctcatcccctgacggtatttaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggagaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacggccgcaaggctgaaactcaaaggaattgacggggacccgcacaagcggtggagcatgtggtttaatttggaagcaacgcgaagaaccttaccaggtcttgacatccttttgaccacttctagagatagagcttttcccttcggggacaaagtgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggatgacgtcaaatcatcatgccccttatgacctgggctacacacgtgctacaatggatggtacaacgagtcgcaaggtcgcgaggccaagctaatctcttaaagccattctcagttcggattgtaggctgcaactcgcctacatgaagccggaatcgctagtaatcgcggatcagaacgccgcggtgaatacgttcccgggtcttgtacacaccgcccgtcacaccacgagagtttgtaacacccgaagccggtgaggtaaccttttaggagccagccgtctaaggtgggatagataattggggtgaagtcgtaacaaggtagccgtatcggaaggtgcggctggatcacct

SEQ ID NO: 494 - DNA, 1497 bp, Catabacter hongkongensis
agagtttgatcctggctcaggacgaacgctggcggcgtgcttaacacatgcaagtcgaacgaagttgctctttgggaagccctcgggtggaactgtgagtatacttagtggcggacgggtgagtaacgcgtgagcaatctgccctgcaatgggggacaacagttggaaacgactgctaataccgcataagaccacgaaaccgcatggtttagaggtaaaaggattcattcgatgcaggatgagctcgcgtcccattagatagttggtgaggtaacggcccaccaagtcaacgatgggtagccgacctgagagggtgatcggccacattggaactgagaaacggtccaaactcctacgggaggcagcagtggggaatattgggcaatgggggaaaccctgacccagcaacgccgcgtgaaggaagaaggccttcgggttgtaaacttttgtcctatgggacgaaaaaaatgacggtaccataggaggaagctccggctaactacgtgccagcagccgcggtaatacgtagggagcaagcgttgtccggaattactgggcgtaaagggtgcgtaggtggccatgtaagtcaggtgtgaaagaccggggctcaaccccggggttgcacttgaaactgtgtggcttgagtacaggagagggaagtggaattcctagtgtagcggtgaaatgcgtagatattaggaggaacaccagtggcgaaggcgactttctggactgtaactgacactgaggcacgaaagcgtggggagcaaacaggattagataccctggtagtccacgccgtaaacgatggatactaggtgtggggggcgatagtcctccgtgccgaagctaacgcattaagtatcccgcctggggagtacgatcgcaaggttgaaactcaaaggaattgacgggggcccgcacaagcagcggagcatgtggtttaattcgaagcaacgcgaagaaccttaccaaggcttgacatcctctgacgcatatagagatatatgttcccttcggggcagagagacaggtggtgcatggttgtcgtcagctcgtgtcgtgagatgttgggttaagtcccgcaacgagcgcaacccttgttgctagttgccagcacgtaaaggtgggaactctagtgagactgccggggacaactcggaggaaggtggggacgacgtcaaatcatcatgccccttatgtcttgggctacacacgtgctacaatggccggtacaaagggcagcgacctcgtaagagtaagcgaatctcaaaaagccggccccagttcggattgtgggctgcaacccgcccacatgaagtcggagttgctagtaatcgcgaatcagcatgtcgcggtgaatgcgttcccgggccttgtacacaccgcccgtcacaccacggaagttgggagcacccgaagccagtggcttaaccgtaaggagagagctgtcgaaggtgagatcaatgactggggtgaagtcgtaacaaggtaacc

SEQ ID NO: 495 - DNA, 1485 bp, Catenibacterium mitsuokai
agagtttgatcctggctcaggatgaacgctggcgccgtgcctaatacatgcaagtcgaacgaatctccttcggaagataagtgcgaacgggtgagtaatacataggtaacctgcccctgtgcgggggataacaggaggaaactcctgctaataccgcatagccatgagcaccgcatggagctcatgccaaatatccttcacgggatagcgcagggatggacctatggcgcattagctagttggcggggcaacggcccaccaaggcaacgatgcgtagccggcctgagagggcggacggccacattgggactgagacacggcccagactctacgggaggcagcagtagggaattttcggcaatgggggaaaccctgaccgagcaacgccgcgtgagcgaagaaggcttcgggtcgtaaagctctgttgtaaaggaagaacgtcggacacaggaaatggtgtgcgagtgacggtactttaccagaaagccacggctaactacgtgccagcagccgcggtaatccgtaggtgccgaccgttatccggaatcattggccgtaaagagggagcaggcggccgcaagggtctgtggtgaaagaccgaagctaaacttcggtaagccatggaaaccgggcggctagagtgcggaagaggatcgtggaattccatgtgtagcggtgaaatgcgtagatatatggaggaacaccagtggcgaagcgacggtctgggccgcaactgacgctcattcccgaaaccgtggggagccaatggcattagataccctagtagtccacgccgtaaacgatggtcactaagtgtcgggggtcaaaccccggtgctgcagtcaacgcaataagtgacccgcctgagtagtacgttcgcaagaatgaaactcaaaggaattgacgggggcccgcacaagcggtggagcatgtggtttaattcgaagcaacgcgaagaaccttaccaggtcttgacatcgatctaaaagggatggagacatcctcatagctatagagaagacaggtggtgcatggttgtcgtcagctcgtgtcgtgagatgttgggttaagtcccgcaacgagcgcaacccctgtcgccagttaccatcattgagttggggactctggcgagactgcctctgcaaggaggaggaaggcggggatgacgtcaaatcatcatgccccttatgacctgggccacacacgtgctacaatggacgggacagagggaagcgaaggcgcgagcgcaagcggaccccagaaacccgttcccagttcggactgcagtctgcaactcgactgcacgaagccggaatcgctagtaatcgcggatcagcatgccgcggtgaatacgttctcgggccttgtacacaccgccgtcacaccatgagagttggcaacacccgaaggcggcggcccaacccgcaaggagggagctgtctaaggtggggctgatgattggggtgaagtcgtaacaaggtaacc

SEQ ID NO: 496 - DNA, 1292 bp, Catonella sp.
  P1 oral clone MB5_P12
gatgaacgctggcggcgtgcctaacacatgcaagtcgaacgagtggcggacgggtgagtaacgcgtgggcaacctgccctatacagggggatagcagctggaaacggctggtaagaccgcataaggaaatcaggtataggatggacccgcgtccgattagccagttggcagggtaaaagcctaccaaagcgacgatcggtagccggactgagaggtcgggcggccacattgggactgagacacggcccaaactcctacgggaggcagcagtgggggatattgcacaatggaggaaactctgatgcagcgacgccgcgtgagtgaagaagtatttcggtatgtaaagctctatcagcagggaagatgacggtacctgactaagaagccccggctaactacgtgccagcagccgcggtaatacgtagggggcaagcgttatccggatttactgggtgtaaagggagcgcaggcggttttgcaagttgagagtggaagcagggggctcaaccccctgactgctcccaaaactgtaaaacttgagtatgggagaggcaggcggaattcctagtgtagcggtgaaatgcttagatattaggaagaacaccggtggcgaaggcggcctgctggaccaactgacgctgaggctcgaaagcgtgggtagcaaacaggattagataccctggtagtccacgctgtaaacgatgaatactaggtgctgggatttcggtgccgtcgcaaacgcattaagtattccacctggggagtacgttcgcgagaatgaagctcaagggaattgacggggacccgcacaagcggtggagcatgtggtttaattcgacgcaacgcgaagaaccttacccggtcttgagatcgacaggtggtgcatggttgtcgtcagctcgtgtcgtgagatgttgggttaagtcccgcaacgagcgcaacccctatttttagtagccagcggccgggcactctaaagagactgccgaggataactcggaggaaggcggggatgacgtcaaatcatcatgccccttatgaccggggctacacacgtgctacaatgtcagtcagagggaagcgaaggcgtgagtcggagcaaatctcaggctgcctcagttcggatgtagtctgcaactcgactacagaagctggaatcgctagtaatcgcaaatcagaatgttgcggtgaatacgttcccgggtcttgtacacaccgcccgtcacaccatgggagtcggaaatgcccgaagtcagtgcctaaggagctgccgaaggcaggtctggtgactg

SEQ ID NO: 497 - DNA, 1553 bp, Catonella morbi
atgagagtttgatcctggctcaggacgaacgctggcggcgtgcctaatacatgcaagtcgaacgaaccgcgactgagtgcttgcacttggtcaaggtgagtggcgaacgggtgagtaacacgtgggtaacctacctcatagtgggggataacagtcggaaacgactgctaataccgcataggacatgggatcacatgattctgtgaggaaaggtggcgcaagctatcgctaagagatggacccgcggtgcattagctagttggtagggtaagggcctaccaaggcgatgatgcatagccgacctgagagggtgatcggccacattgggactgagacacggcccaaactcctacgggaggcagcagtagggaatcttccgcaatggacgcaagtctgacggagcaacgccgcgtgagtgaagaaggtcttcggatcgtaaagctctgttgttagagaagaacagcgcatagagtaactgctatgcgtgtgacggtatctaaccagaaagccacggctaactacgtgccagcagccgcggtaatacgtaggtggcgagcgttgtccggatttattgggcgtaaagggagtgtaggcggtcttttaagtctgatgtgaaagcccacggctcaaccgtggagggtcattggaaactgggagacttgagtgcagaagaggagagcggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggaggggttccacccttcagtgctggagttaacgcaataagcactccgcctggggagtacggccgcaaggctgaaactcaaaggaattgacggggacccgcacaagcggtggagcatgtggtttaattcgaagcaacgcgaagaaccttaccaggtcttgacatcccgacgaccgctctagagatagagtttttcttcggaacgtcggtgacaggtggtgcatggttgtcgtcagctcgtgtcgtgagatgttgggttaagtcccgcaacgagcgcaacccctataactagttgccagcattgagatggggactctagttagactgccggtgacaaaccggaggaaggtggggatgacgtcaaatcatcatgccccttatgacctgggctacacacgtgctacaatggatggtacaacgagcagcgaactcgcgagggtaagcgaatctctaaaagccattctcagttcggattgtagtctgcaactcgactacatgaagccggaatcgctagtaatcgcggatcagcacgccgcggtgaatacgttcccgggtcttgtacacaccgcccgtcacaccacgagagtttgtaacacccgaagccggtggcctaaccttttaggagggagccgtcgaaggtgggatagatgattggggtgaagtcgtaacaaggtagccgtatcggaaggtgcggctggatcacctcctttct

SEQ ID NO: 498 - DNA, 1366 bp, Catonella sp.
  oral clone FL037
gagtttgatcctggctcaggatgaacgctggcggcgtgcctaacacatgcaagtcgaacgagtggcggacgggtgagtaacgcgtgggtaacctgccccgtacagggggatagcgtcgggaaactgacggtaagaccgcatagggaaaactggtatgggatggacccgcgtccgattagccagttggcagggtaaaggcctaccaaagcttcgatcggtagccggactgagaggtcggacggccacattgggactgagacacggcccagactcctacgggaggcagcagtgggggatattgcacaatggaggaaactctgatgcagcgacgccgcgtgagtgaagaagtgctccggcatgtaaagctctttcagcagggaagatgacggtacctgaataagaagccccggctaactacgtgccagcagccgcggtaatacgtagggggcaagcgttatccggatttactgggtgtaaagggagcgcaggcggtctggcaagttgagagtggaagcagggggctcaaccccctgactgctcccaaaactgttggactggagtatgggagaggcaggcggaattcctagtgtagcggtgaaatgctcagatattaggaagaacaccggtggcgaaggcggcctgctggaccaactgacgctgaggctcgagagcgtggggagcgaacaggattagataccctggtagtccacgccgtaaacgatgaatactaggtgccgggatttcggtgccgtcgcaaacgcattgagtattccacctggggagtacgttcgcaagaatgaaactcaaaggaattgacggggacccgcgcaagcggtggagcatgtggtttaattcgaagcaacgcgaagaaccttacccggtcttgagatcgacaggtggtgcatggttgtcgtcagctcgtgtcgtgagatgttgggttaagtcccgcaacgagcgcaacccctgttcttagtagccagcggccgggcactctaaggagactgccggggataacccggaggaaggcggggatgacgtcaaatcatcatgccccttatgacttgggcgacacacgtgctacaatggcgtacaaagggaagcgagctcgtgagagtaagcgaaactcaaaacgtctcagttcggatgtagtctgcaacccgactacagaagctggaatcgctagtaatcgcagatcagcatgctgcggtgaatacgttcccgggtcttgtacacaccgcccgtcacaccatgggagtcggtaatgcccgaagccagtaaccagggagctgtcgaaggcaggactgataactggggtgaagtcgtaacaaggtagccgtatcggaaggtgcggctggaacacctcctt

SEQ ID NO: 499 - DNA, 1403 bp, Cedecea davisae
cggacgggtgagtaatgtctggggatctgcctgatggagggggataactactggaaacggtagctaataccgcataacgtcgcaagaccaaagagggggaccttcgggcctcttgccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcattaaggttaataacctyrgtgattgacgttactcgcagaagaagcaccggctaactccgtgccagcagccgcggtaatacggagggtgcaagcgttaatcggaattactgggcgtaaagcgcacgcaggcggtttgttaagtcggatgtgaaatccccgggctcaacctgggaactgcattcgaaactggcaagcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaccaaggtaa

SEQ ID NO: 500 - DNA, 1444 bp, Cellulosimicrobium funkei
gacgaacgctggcggcgtgcttaacacatgcaagtcgaacgatgatgcccagcttgctgggtggattagtggcgaacgggtgagtaacacgtgagtaacctgcccttgacttcgggataactccgggaaaccggggctaataccggatatgagccgccytcgcatgggggtggttggaaagtttttcggtcagggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgaaggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggtttgtcgcgtctggtgtgaaaactcgaggctcaacctcgagcttgcatcgggtacgggcagactagagtgcggtaggggagactggaattcctggtgtagcggtggaatgcgcagatatcaggaggaacaccgatggcgaaggcaggtctctgggccgcaactgacgctgaggagcgaaagcatggggagcgaacaggattagataccctggtagtccatgccgtaaacgttgggcactaggtgtggggctcattccacgagttccgtgccgcagcaaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcacgggaagccaccagagatggtggtctctttggacactcgtgcacaggtggtgcatggttgtcgtcagctcgtgtcgtgagatgttgggttaagtcccgcaacgagcgcaaccctcgtcccatgttgccagcgggttatgccggggactcatgggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagcccatggcccaaccgttcgcggggggagtggtcgaaggtgggactggcgattgggact

SEQ ID NO: 501 - DNA, 1470 bp, Cetobacterium somerae
agagtttgatcctggctcaggatgaacgctgacagaatgcttaacacatgcaagtcgattcgatttaccttcgggtattgaggatggcggacgggtgagtaacgcgtaaggaacttgcctcttggtctgggacaactgttggaaacgacagctaataccggatattatgagattctcgcatgggaaacttatgaaagctatatgcgccaagagagagccttgcgttccattagctagttggtggggtaacggcccaccaaggcgacgatggatagccggcctgagagggtgaacggccacaaggggactgagacacggcccttactcctacgggaggcagcagtggggaatattggacaatgggccacaagcctgatccagcaattctgtgtgcacgatgaaggtcttcggattgtaaagtgctttcagttgggaagaagaaagtgacggtaccaacagaagaagcgacggctaaatacgtgccagcagccgcggtaatacgtatgtcgcaagcgttatccggatttattgggcgtaaagcgcgtctaggcggaaaaataagtctgatgttaaaatgcggggctcaactccgtattgcgttggaaactgtttttctagagtactggagaggtgggcggaactacaagtgtagaggtgaaattcgtagatatttgtaggaatgccgatggagaagtcagctcactggacagatactgacgctaaagcgcgaaagcgtggggagcaaacaggattagataccctggtagtccacgccgtaaacgatgatcactaggtgttgggggtcgaacctcagcgcccaagctaacgcgataagtgatccgcctggggagtacgcacgcaagtgtgaaactcaaaggaattgacggggacccgcacaagcggtggagcatgtggtttaattcgacgcaacgcgagaaaccttaccagcgtttgacatcctaagaagtttccagagatggattcgtgccggcttgccggaacttagtgacaggtggtgcatggctgtcgtcagctcgtgtcgtgagatgttgggttaagtcccgcaacgagcgcaacccctattgtatgttgctaccattaagttgagcactcatgcgatactgcctgcgatgagcaggaggaaggtggggatgacgtcaagtcatcatgccccttatacgctgggctacacacgtgctacaatgggcagtacagagagttgccaacccgcgagggtgagctaatctcttaaagctgttcttagttcggattgtactctgcaactcgagtacatgaagttggaatcgctagtaatcgcaaatcagcatgttgcggtgaatacgttctcgggtcttgtacacaccgcccgtcacaccacgagagttggttgcacctgaagtagcaggcctaaccgtaaggagggatgttcctaaggtgtgattagcgattggggtgaagtcgtaacaaggt

SEQ ID NO: 502 - DNA, 1549 bp, Chlamydia muridarum
ctgagaatttgatcttggttcagattgaacgctggcggcgtggatgaggcatgcaagtcgaacggaacaattgcttcggtgattgtttagtggcggaagggttagtaatgcatagataatttgtccttaacttgggaataacggttggaaacggccgctaataccgaatgtggcgtagattaggcatctaaattacgttaaagaaggggatcttcggacctttcggttaagggagagtctatgtgatatcagctagttggtggggtaaaggcctaccaaggctatgacgtctaggcggattgagagattggccgccaacactgggactgagacactgcccagactcctacgggaggctgcagtcgagaatctttcgcaatggacggaagtctgacgaagcgacgccgcgtgtgtgatgaaggctctagggttgtaaagcactttcgcttgggaataagagaagacggttaatacccgttggatttgagcgtaccaggtaaagaagcaccggctaactccgtgccagcagctgcggtaatacggagggtgctagcgttaatcggatttattgggcgtaaagggcgtgtaggcggaaaggtaagttagttgtcaaatctcggggctcaaccccgaatcggcatctaaaactatttttctagagggtagatggagaaaagggaatttcacgtgtagcggtgaaatgcgtagatatgtggaagaacaccagtggcgaaggcgcttttctaatttatacctgacgctaaggcgcgaaagcaaggggagcaaacaggattagataccctggtagtccttgccgtaaacgatgcatacttgatgtggatggtctcaaccccatccgtgtcggagctaacgcgttaagtatgccgcctgaggagtacactcgcaagggtgaaactcaaaagaattgacgggggcccgcacaagcagtggagcatgtggtttaattcgatgcaacgcgaaggaccttacctgggtttgacatgcatatgaccgcggcagaaatgtcgttttccgcaaggacatatgcacaggtgctgcatggctgtcgtcagctcgtgccgtgaggtgttgggttaagtcccgcaacgagcgcaacccttatcgttagttgccagcacttagggtgggaactctaacgagactgcctgggttaaccaggaggaaggcgaggatgacgtcaagtcagcatggcccttatgcccagggcgacacacgtgctacaatggccagtacagaaggtagcaagatcgcgagatggagcaaatcctcaaagctggccccagttcggattgtagtctgcaactcgactacatgaagtcggaattgctagtaatggcgtgtcagccataacgccgtgaatacgttcccgggccttgtacacaccgcccgtcacatcatgggagttggttttaccttaagtcgttgactcaacccgcaagggggagaggcgcccaaggtgaggctgatgactgggatgaagtcgtaacaaggtagccctaccggaaggtggggctggatcacctccttt

SEQ ID NO: 503 - DNA, 1553 bp, Chlamydia psittaci
ttttctgagaatttgatcttggttcagattgaacgctggcggcgtggatgaggcatgcaagtcgaacggaataatgacttcggttgttatttagtggcggaagggttagtaatacatagataatctgtcctcaacttgggaataacggttggaaacgaccgctaataccgaatgtggtatgtttaggcatctaaaacatattaaagaaggggatcttcggacctttcggttgagggagagtctatgggatatcagcttgttggtggggtaatggcctaccaaggctttgacgtctaggcggattgagagattgaccgccaacactgggactgagacactgcccagacttctacggaaggctgcagtcgagaatctttcgcaatggacgaaagtctgacgaagcgacgccgcgtgtgtgatgaaggctctagggttgtaaagcactttcgcttgggaataagagagattggctaatatccaatcgatttgagcgtaccaggtaaagaagcaccggctaactccgtgccagcagctgcggtaatacggagggtgctagcgttaatcggatttattgggcgtaaagggcgtgtaggcggaaaggaaagttagatgttaaatcttggggctcaaccccaagccagcatctaatactatctttctagagggtagatggagaaaagggaattccacgtgtagcggtgaaatgcgtagatatgtggaagaacaccagtggcgaaggcgcttttctaatttacacctgacgctaaggcgcgaaagcaaggggagcaaacaggattagataccctggtagtccttgccgtaaacgatgcatacttgatgtggatagtctcaaccctatccgtgtcgtagctaacgcgttaagtatgccgcctgaggagtacactcgcaagggtgaaactcaaaagaattgacgggggcccgcacaagcagtggagcatgtggtttaattcgatgcaacgcgaagaaccttacctgggcttgacatgtatttgaccgcggcagaaatgtcgttttccgcaaggacagatacacaggtgctgcatggctgtcgtcagctcgtgccgtgaggtgttgggttaagtcccgcaacgagcgcaacccttatcgttagttgccaacacttagggtgggaactctaacgagactgcctgggttaaccaggaggaaggcgaggatgacgtcaagtcagcatggcccttatgcccagggctacacacgtgctacaatggccagtacagaaggtagcaatatcgtgagatggagcaaatcctcaaagctggccccagttcggattgtagtctgcaactcgactacatgaagtcggaattgctagtaatggcgtgtcagctataacgccgtgaatacgttcccgggccttgtacacaccgcccgtcacatcatgggagttggttttgccttaagtcgttgactcaacctgcaaaggagagaggcgcccaaggtgaggctgatgactgggatgaagtcgtaacaaggtagccctaccggaaggtggggctggatcacctcctttt

SEQ ID NO: 504 - DNA, 1554 bp, Chlamydia trachomatis
ttttctgagaatttgatcttggttcagattgaacgctggcggcgtggatgaggcatgcaagtcgaacggagcaattgtttcggcaattgtttagtggcggaagggttagtaatgcatagataatttgtccttaacttgggaataacggttggaaacggccgctaataccgaatgtggcgatatttgggcatccgagtaacgttaaagaaggggatcttaggacctttcggttaagggagagtctatgtgatatcagctagttggtggggtaaaggcctaccaaggctatgacgtctaggcggattgagagattggccgccaacactgggactgagacactgcccagactcctacgggaggctgcagtcgagaatctttcgcaatggacggaagtctgacgaagcgacgccgcgtgtgtgatgaaggctctagggttgtaaagcactttcgcttgggaataagagaaggcggttaatacccgctggatttgagcgtaccaggtaaagaagcaccggctaactccgtgccagcagctgcggtaatacggagggtgctagcgttaatcggatttattgggcgtaaagggcgtgtaggcggaaaggtaagttagttgtcaaagatcggggctcaaccccgagtcggcatctaatactatttttctagagggtagatggagaaaagggaatttcacgtgtagcggtgaaatgcgtagatatgtggaagaacaccagtggcgaaggcgcttttctaatttatacctgacgctaaggcgcgaaagcaaggggagcaaacaggattagataccctggtagtccttgccgtaaacgatgcatacttgatgtggatggtctcaaccccatccgtgtcggagctaacgcgttaagtatgccgcctgaggagtacactcgcaagggtgaaactcaaaagaattgacgggggcccgcacaagcagtggagcatgtggtttaattcgatgcaacgcgaaggaccttacctgggtttgacatgtatatgaccgcggcagaaatgtcgttttccgcaaggacatatacacaggtgctgcatggctgtcgtcagctcgtgccgtgaggtgttgggttaagtcccgcaacgagcgcaacccttatcgttagttgccagcacttagggtgggaactctaacgagactgcctgggttaaccaggaggaaggcgaggatgacgtcaagtcagcatggcccttatgcccagggcgacacacgtgctacaatggccagtacagaaggtagcaagatcgtgagatggagcaaatcctcaaagctggccccagttcggattgtagtctgcaactcgactacatgaagtcggaattgctagtaatggcgtgtcagccataacgccgtgaatacgttcccgggccttgtacacaccgcccgtcacatcatgggagttggttttaccttaagtcgttgactcaacccgcaagggagagaggcgcccaaggtgaggctgatgactaggatgaagtcgtaacaaggtagccctaccggaaggtggggctggatcacctcctttt

SEQ ID NO: 505 - DNA, 1407 bp, Chlamydiales bacterium NS11
ggtatgggggcaactccatatagtggcgcaagggttagtaatacatagataatctgcctctgacctgggaataacggctggaaacggccatacatagataatctacctctgacctgggaataacggctggaaacggccgctaataccgaatgaggtggcataaggcatcttgtgcttatcaatgcgggggatcgaaagacctcgtggttagagaagagtctatgggatatcagctagttggtgaggtaatggctcaccaaggctaagacgtctaggcggattgagagattgaccgccaacactgggactgagacactgcccagactcctacgggaggctgcagtcgagaatctttcgcaatgggcgcaagcctgacgaagcgacgccgtgtgagcgaagaaggccttcgggttgtaaagctctttcgctagggaacaagagatataggacaataccctatagatttgatggtacttggtaaagaagcaccggctaactccgtgccagcagctgcggtaatacggagggtgcaagcattgatcggaattactgggcgtaaagggcgcgtaggcggcagaataagtcagatgtgaaattccggggctcaaccccggagctgcatttgaaactattcaactagaggacagttagggtaaacggaattccacgtgtagcggtgaaatgcgtagatatgtggaagaacaccggtggtgaagacggtttactgggctgatactgacgctgaggcgcgaaagcatggggagcaaacaggattagataccctggtagtcctagccttaaacgatgtatactaggagtaggtgggctcaacccccactgtaccggagctaacgcattaagtatgccgcctggggagtacgctcgcaagggtgaaactcaaaagaattgacgggggcccgcacaagcagtggagcatgtggtttaattcgatgcaacgcgaagaaccttacctaggctcgaaatgtagaggacgatatcagagatgatatttcccgaaagggtctctatataggtgctgcatggctgtcgtcagctcgtgccgtgaggtgtttggttaagtccagcaacgagcgcaacccttatcgttagttgccaacacgtaaaggcgggaactctaacgagactgcctgggttaaccaggaggaaggtgaggatgacgtcaagtccgcatggcctttatgtccagggctacacacgtgctacaatggtcggtacagaaggcagcgaaaccgcaaggcgaagcaaatccggaaaaaccgatctcagttcagattgtagtctcaactcggctacatgaagttggaattgctagtaatggcgtgtcagcaacaacgccgtgaatacgttcccgggccttgtacacactgcccgtcacatcatgggagt

SEQ ID NO: 506 - DNA, 1334 bp, Chlamydiales bacterium NS13
tagtggcgcaagggttagtaatacatggataatccacctctcacgtaggaataacggctggaaacggccgctaataccgaatgaggtggcttaaggcatcttaccatagtcaaagcgggggatcgaaagacctcgcggttagagaggagttcatgagatatcagctagttggtgaggtaatggctcaccaaggctaagacgtctaggcggattgagagattgaccgccaacactgggactgagacactgcccagactcctacgggaggctgcagtcgagaatcttgcgcaatgggcgcaagcctgacgaagcgacgccgtgtgagcgaagaaggccttcaggttgtaaagctctttcgctagggaacaagagagtcgggataataatcagatgacttgatggtacttggtaaagaagcaccggctaactccgtgccagcagctgccgtactaccgagggtgcaagcattgatcggaattactgcgcgtaaagggcgcgtacgccgcaggataagtcagatgtgaaattccggggctcaaccccggagctgcatttgaaactctcttgctagaggacagttagggtaaacggaattccacgtgtagcggtgaaatgcgtagatatgtggaagaacaccagtggtgaagacggttttctgggctggaactgacgctgaggcgcgggagctaggggagcaaacaggattagataccctggtagtcctagccgtaaacgatgcatactggatgtagggaggctcaacccttattgtatcggagctaacgcgttaagtatgccgcctggggagtacgcccgcaagggtgaaactcaaaagaattgacgggggcccgcacaagcagtggagcatgtggtttaattcgatgcaacgcgaagaaccttacccaggctcgaagtgtagagaacaagcgcagagatgcggtgtctcttcgggacatctatataggtgctgcatggctgtcgtcagctcgtgccgtgaggtgttgggttaagtcccgcaacgagcgcaacccttattgtcagttgccaacgcgtaaaggcggggactctggcaagactgcctaggttaactaggaggaaggtgaggatgacgtcaagtccgcatggcccttatgtccggggctacacacgtgctacaatggtcgatacagagggctgcgaagccgcgaggcggagcaaatccgataaaaccgatctcagttcagattgcagtctcaactcgactacatgaagttggaattcctagtaaaggcgtgtcagctacagcgccgtgaatacgttcccgggccttgtagacaccgcccgtcacatcatgg

SEQ ID NO: 507 - DNA, 1337 bp, Chlamydiales bacterium NS16
tagtggcggaagggttagtaatacatgagtaacctacctctaacctggggataacggttggaaacggccgctaataccgaatgaggagacgaggggaatgctcatggcttcaaagtaggggatcttgaagggaccttgcggtaggagagaggggtatgggatatcagctagttggtgtggtaaaggcgcaccaaggctaagacgtctaggcggattgagaggttgaccgccaacactgggactgagacactgcccagactcctacgggaggctgcagtcgagaatctttcgcaatgggcgaaagcgtgacgaagcgacgccgtgtggacgatgaaggccttcgggttgtaaagtcctttcgccagggaacaagaaaaattaactaataacttatcaatttgagcgtactaggtaaagaagcaccggctaactccgtgccagcagctgcggtaatacggagggtgcaagcattaatcggatttattgggcgtaaagagcgcgtaggcgggcaagcaagtcagatgtgaaattccggagctcaactccggagctgcatttgaaactacttgtctagaggatggacggagaaaacggaattccacgtgtagcggtgaaatgcgtagatatgtggaagaacaccggtggcgaaggcggttttctagtttattcctgacgctgaggcgcgagagcaaggggagcaaacagggttagataccctggtagtccttgccgtaaacgttgcatacttgatgtatttgggctcaaccccgactgtgtcgaacctaacgcgataagtataccacctgaggagtacgctcgcaagggtgaaactcaaaagaattgacgggggcccgcacaagcagtggagcatgtggtttaattcgatgcaacgcgaagaaccttacccaggcttgacatatagaagaccacatcagaaatgttgtctcccgcaagggcttttgtacaggtgctgcatggctgtcgtcagctcgtgccgtgaggtgttgggttaagtcccgcaacgagcgcaacccttgtcattagttgccaacatttcgtgatggggactctaatgagactgcctgggttaactaggaggaaggtgaggatgacgtcaagtccgcatggcctttatgtctggggctacacacgtgctacaatggtcgatacagaaggcagcgaagccgcaaggtggagcaaatcctcaaaaccgatctcagttcggatagaagtctgcaactcgacttcttgaagttggaattgctagtaatgacgtgtcagcaataacgtcgtgaatacgttcccgggccttgtacacaccgcccgtcacatcacgg

SEQ ID NO: 508 - DNA, 1548 bp, Chlamydophila pecorum
ctgagaatttgatcttggttcagattgaacgctggcggcgtggatgaggcatgcaagtcgaacggaataatggcttcggctattatttagtggcggaagggttagtaatacatagataatttgtcttaacttgggaataacggttggaaacggccgctaataccgaatgtggtgtgtttaggcatctaaattacattaaagaaggggatcttcggacctttcggttaagagaaagtctgtgggatatcagcttgttggtggggtaatggcctaccaaggctatgacgtctaggcggattgagagattgaccgccaacactgggactgagacactgcccagactcctacgggaggctgcagtcgagaatctttcgcaatggacgaaagtctgacgaagcgacgccgcgtgtgtgatgaaggctctagggttgtaaagcactttcgcctgggaataagagagattggctaatatccaattgatttgagcgtaccaggtaaagaagcaccggctaactccgtgccagcagctgcggtaatacggagggtgctagcgttaatcggatttattgggcgtaaagggcgtgtaggcggaaaggaaagttagatgtcaaatcttgaggctcaacctcaagtcggcatctaatactatctttctagaggttggatggagaaaagggaattccacgtgtagcggtgaaatgcgtagatatgtggaagaacaccagtggcgaaggcgcttttctaatttttcctgacgctaaggcgcgaaagcaaggggagcaaacaggattagataccctggtagtccttgctgtaaacgatgcatacttgatgtggatggtctcaaccccatccgtgtcggagctaacgcgttaagtatgccgcctgaggagtacactcgcaagggtgaaactcaaaagaattgacgggggcccgcacaagcagtggagcatgtggtttaattcgatgcaacgcgaagaaccttacctgggcttgacatgtatttgaccgcggcagaaatgtcgttttccgtaaggacagatacacaggtgctgcatggctgtcgtcagctcgtgccgtgaggtgttgggttaagtcccgcaacgagcgcaacccttatcgttagttgccagcactttgggtgggaactctaacgagactgcctgggttaaccaggaggaaggcgaggatgacgtcaagtcagcatggcccttatgtccagggcgacacacgtgctacaatgggtagtacagaaggtagcaagatcgtgagatggagcaaatccttaaagctatcctcagttcggattgtagtctgcaactcggctacatgaagtcggaattgctagtaatggcgtgtcagccataacgccgtgaatacgttcccgggccttgtacacaccgcccgtcacatcatgggagttggtttcaccttaagtcgttgactcaacctatttttaggagggaggcgcccaaggtgaggctgatgactgggatgaagtcgtaacaaggtagccctaccggaaggtggggctggatcacctccttt

SEQ ID NO: 509 - DNA, 1552 bp, Chlamydophila pneumoniae
ctgagaatttgatcttagttcagattgaacgctggcggcgtggatgaggcatgcaagtcgaacggaataatgacttcggttgttatttagtggcggaagggttagtagtacatagataatctgccctcaacttggggataacggttggaaacgatcgctaataccgaatgtagtgtaattaggcatctaatatatattaaagaaggggatcttcggacctttcggttgaggaagagtttatgcgatatcagcttgttggtggggtaaaagcccaccaaggcgatgacgtctaggcggattgagagattgaccgccaacactgggactgagacactgcccagactcctacgggaggctgcagtcgagaatctttcgcaatggacgaaagtctgacgaagcgacgccgcgtgtgtgatgaaggccttagggttgtaaagcactttcgcctgggaataagagagattggctaatatccaatcgatttgagcgtaccaggtaaagaagcaccggctaactccgtgccagcagctgcggtaatacggagggtgctagcgttaatcggatttattgggcgtaaagggcgtgtaggcggaaaggaaagttagatgttaaattttggggctcaaccccaagtcagcatttaaaactatctttctagaggatagatggggaaaagggaattccacgtgtagcggtgaaatgcgtagatatgtggaagaacaccagtggcgaaggcgcttttctaatttatacctgacgctaaggcgcgaaagcaaggggagcaaacaggattagataccctggtagtccttgccgtaaacgatgcatacttgatgtggatggtctcaaccccatccgtgtcggagctaacgtgttaagtatgccgcctgaggagtacactcgcaagggtgaaactcaaaagaattgacgggggcccgcacaagcagtggagcatgtggtttaattcgatgcaacgcgaaggaccttacctggacttgacatgtatttgacaactgtagaaatacagctttccgcaaggacagatacacaggtgctgcatggctgtcgtcagctcgtgccgtgaggtgttgggttaagtcccgcaacgagcgcaacccttatcgttagttgccagcacttagggtgggaactctaacgagactgcctgggttaaccaggaggaaggcgaggatgacgtcaagtcagcatggcccttatgtccagggcgacacacgtgctacaatggttagtacagaaggtagcaagatcgtgagatggagcaaatcctaaaagctagccccagttcggattgtagtctgcaactcgactacatgaagtcggaattgctagtaatggcgtgtcagccataacgccgtgaatacgttctcgggccttgtacacaccgcccgtcacatcatgggagttggttttaccttaagtcgttgactcaacctatttataggagagaggcgcccaaggtgaggctgatgactgggatgaagtcgtaacaaggtagccctaccggaaggtggggctggatcacctccttttt

SEQ ID NO: 510 - DNA, 1548 bp, Chlamydophila psittaci
ctgagaatttgatcttggttcagattgaacgctggcggcgtggatgaggcatgcaagtcgaacggaataatgacttcggttgttatttagtggcggaagggttagtaatacatagataatctgtcctcaacttgggaataacggttggaaacgaccgctaataccgaatgtggtatgtttaggcatctaaagcatattaaagaaggggatcttcggacctttcggttgagggagagtctatgggatatcagcttgttggtggggtaatggcctaccaaggctttgacgtctaggcggattgagagattgaccgccaacactgggactgagacactgcccagacttctacggaaggctgcagtcgagaatctttcgcaatggacgaaagtctgacgaagcgacgccgcgtgtgtgatgaaggctctagggttgtaaagcactttcgcttgggaataagagagattggctaatatccaatcgatttgagcgtaccaggtaaagaagcaccggctaactccgtgccagcagctgcggtaatacggagggtgctagcgttaatcggatttattgggcgtaaagggcgtgtaggcggaaaggaaagttagatgttaaatcttggggctcaaccccaagccagcatctaatactatctttctagagggtagatggagaaaagggaattccacgtgtagcggtgaaatgcgtagatatgtggaagaacaccagtggcgaaggcgcttttctaatttacacctgacgctaaggcgcgaaagcaaggggagcaaacaggattagataccctggtagtccttgccgtaaacgatgcatacttgatgtggatagtctcaaccctatccgtgtcgtagctaacgcgttaagtatgccgcctgaggagtacactcgcaagggtgaaactcaaaagaattgacgggggcccgcacaagcagtggagcatgtggtttaattcgatgcaacgcgaagaaccttacctgggcttgacatgtatttgaccgcggcagaaatgtcgttttccgcaaggacagatacacaggtgctgcatggctgtcgtcagctcgtgccgtgaggtgttgggttaagtcccgcaacgagcgcaacccttatcgttagttgccaacacttagggtgggaactctaacgagactgcctgggttaatcaggaggaaggcgaggatgacgtcaagtcagcatggcccttatgcccagggctacacacgtgctacaatggccagtacagaaggtagcaatatcgtgagatggagcaaatcctcaaagctggccccagttcggattgtagtctgcaactcgactacatgaagtcggaattgctagtaatggcgtgtcagctataacgccgtgaatacgttcccgggccttgtacacaccgcccgtcacatcatgggagttggttttgccttaagtcgttgactcaacctgcaaaggagagaggcgcccaaggtgaggctgatgactgggatgaagtcgtaacaaggtagccctaccggaaggtggggctggatcacctccttt

SEQ ID NO: 511 - DNA, 1419 bp, Chloroflexi sp.
  P1
gatgaacgctggcggcgtgcttaatacatgcaagtcgaacgggtgcagcgatgtaccagtggcgaacgggtgagtaacacgttggtgacctgccccaaagaggggaataccgcttggaaacgagcgacaaaaccgcataagctatcgggagtcagagagccgatagtaaaagaggaatctactttgggaggggcctgcggcccatcagctagttggagaggtaacggctcaccaaggcgaagacgggtaggggacctgagagggtgatcccccacaatggaactgaaacacggtccatacacctacgggtggcagcagtagggaatattgctaaatgggcgaaagcctgaagcagcaacgccgcgtgaacgaagaaggccttcgggtcgtaaagttcttttacgtgggaagaggaaggacagtaccacgggaataagtctcggctaactacgtgccagcagccgcggtaaaacgtaggaggcgagcgttatccggatttactgggcgtaaagagcgtgtaggaggcaaaacaagacggatgtgaaagcccccggcttaaccgggggaggtcgtacgtgactgtagagctagagtgagttagaggtaagcggaactccgggagtagtggtgaaatgcgtagatatccggaagaacatcagaggcgaaagcggcttactgggacttaactgacactgagacgcgaaagccagggtagcaaacgggattagagaccccggtagtcctggctgtaaacgatgtagactggacgttttcggggtaaaagctgagagtgtcgaagcgaacgcgataagtctaccgcctggggagtacggtcgcaggattaaaactcaaaggaattgacgggggcccgcacaagcagcggagcgtgtggtttaattcgatgatacacgaagaaccttaccggggtttgacatacaggtagtaagaaggcgaaagccggatgacccttacgggggagcctgaacaggtgctgcatggctgtcgtcagctcgtgtcgtgagatgttcggttaagtccgctaacgagcgcaacccttgtcgcgtgttacaagtgtcacgcgagaccgccggtagaaagccggaggaaggtggggatgacgtcaagtcagcatggcctttatatcccgggctacacacacgctacaatggccggtacagagggtagcgaagccgcgaggcggagccaatcctgaaaagccggtcgtagttcagattgcaggctgcaactcgcctgcatgaagatggagttgctagtaaccgtaggtcagcgatactacggtgaatacgttcccgggccttgtacacaccgcccgtcacgtcatgggagttggcaacacctgaagccggtatcctgaccgagaggagggagccgtcaaaggtggggttgatgattggggtg

SEQ ID NO: 512 - DNA, 1334 bp, Christensenella minuta
ggctcaggacgaacgctggcggcgtgcttaacacatgcaagtcgaacgagtggcggacgggtgagtaacgcgtgagcaacctgccctgcaacgggggacaacagttggaaacgactgctaataccgcatgagaaaagtcgatgcaggatgggctcgcgtcccattagatagttggtgaggtaacggcccaccaagtcaacgatgggtagccgacctgagagggtgatcggccacactggaactgagacacggtccagactcctacgggaggcagcagtggggaatattgggcaatgggggaaaccctgacccagcaacgccgcgtgagggaagaaggtcttcggattgtaaacctttgtcctatgggacgatgacggtaccataggaggaagctccggctaactacgtgccagcagccgcggtaatacgtagggagcaagcgttgtccggaattactgggcgtaaagggtgcgtaggtggtcatgtaagtcagatgtgaaagaccggggcttaaccccggggttgcatttgaaactgtgtgacttgagtacaggagagggaagtggaattcctagtgtagcggtgaaatgcgtagatattaggaggaacaccagtggcgaaggcgactttctggactgactgacactgaggcacgaaagcgtggggagcaaacaggattagataccctggtagtccacgccgtaaacgatggatactaggtgtggggcgttccgtgccgaagcaaacgcattaagtatcccgcctggggagtacgatcgcaaggttgaaactcaaaggaattgacgggggcccgcacaagcagcggagcatgtggtttaattcgaagcaacgcgaagaaccttaccaaggcttgacatcgacaggtggtgcatggttgtcgtcagctcgtgtcgtgagatgttgggttaagtcccgcaacgagcgcaacccttattgctagttgccagcgcgcgggaactctagtgagactgccggggacaactcggaggaaggtggggacgacgtcaaatcatcatgccccttatgtcttgggctacacacgtgctacaatggccggcaaagggcagcgaacccgtaaggggaagcgaatctcaaccggtcccagttcggatgtgggctgcaacccgcccacagaagtcggagttgctagtaatcgcgaatcagcatgtcgcggtgaatgcgttcccgggccttgtacacaccgcccgtcacaccacggaagttgggagcacccgaagccagtgcttagagagctgtcgaaggtgagatcaatgactggggtgaagtcgtaacaaggtagccgtatcggaagg

SEQ ID NO: 513 - DNA, 1544 bp, Chromobacterium violaceum
tgaactgaagagtttgatcctggctcagattgaacgctggcggcatgctttacacatgcaagtcgaacggtaacagggtgcttgcaccgctgacgagtggcgaacgggtgagtaatgcgtcggaatgtaccgtgtaatgggggatagctcggcgaaagccggattaataccgcatacgccctgagggggaaagcgggggatcgaaagacctcgcgttatacgagcagccgacgtctgattagctagttggtgaggtaagagctcaccaaggcgacgatcagtagcgggtctgagaggatgatccgccacactgggactgagacacggcccagactcctacgggaggcagcagtggggaattttggacaatgggggcaaccctgatccagccatgccgcgtgtctgaagaaggccttcgggttgtaaaggacttttgtcagggaggaaatcccgctggttaatacccggcggggatgacagtacctgaagaataagcaccggctaactacgtgccagcagccgcggtaatacgtagggtgcgagcgttaatcggaattactgggcgtaaagcgtgcgcaggcggttgtgcaagtctgatgtgaaagccccgggcttaacctgggaacggcattggagactgcacagctagagtgcgtcagaggggggtagaattccacgtgtagcagtgaaatgcgtagagatgtggaggaataccgatggcgaaggcagccccctgggatgacactgacgctcatgcacgaaagcgtggggagcaaacaggattagataccctggtagtccacgccctaaacgatgtcaactagctgttgggggtttgaatccttggtagcgtagctaacgcgtgaagttgaccgcctggggagtacggccgcaaggttaaaactcaaaggaattgacggggacccgcacaagcggtggatgatgtggattaattcgatgcaacgcgaaaaaccttacctgctcttgacatgtacggaacttgccagagatggcttggtgcccgaaagggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaaaccggaggaaggtggggatgacgtcaagtcctcatggcccttatgagcagggcttcacacgtcatacaatggtcggtacagagggttgccaagccgcgaggtggagctaatctcagaaaaccgatcgtagtccggatcgcactctgcaactcgagtgcgtgaagtcggaatcgctagtaatcgcagatcagcatgctgcggtgaatacgttcccgggtcttgtacacaccgcccgtcacaccatgggagtgagtttcaccagaagtgggtaggctaaccgcaaggaggccgcttaccacggtgggattcatgactggggtgaagtcgtaacaaggtagccgtaggggaacctgcggctggatcacctcctttctagaga

SEQ ID NO: 514 - DNA, 1480 bp, Chryseobacterium anthropi
ctagagtttgatcctggctcaggatgaacgctagcgggaggcctaacacatgcaagccgagcggtagagtttcttcggaaacttgagagcggcgcacgggtgcgtaacacgtgtgcaacctacctttatctgggggatagcctttcgaaaggaagattaataccccataatataatgattggcatcaattattattgaaaactccggtggatagagatgggcacgcgcaagattagatagttggtgaggtaacggctcaccaagtcaatgatctttaggggtcctgagagggagatcccccacactggtactgagacacggaccagactcctacgggaggcagcagtgaggaatattggacaatgggtgagagcctgatccagccatcccgcgtgaaggawgacggtcctatggattgtaaacttcttttgtacagggataaacctactctcgtgagggtagctgaaggtactgtacgaataagcaccggctaactccgtgccagcagccgcggtaatacggagggtgcaagcgttatccggatttattgggtttaaagggtccgtaggcggacttgtaagtcagtggtgaaatctcatagcttaactatgaaactgccattgatactgcaggtcttgagtaaatttgaagtggctggaataagtagtgtagcggtgaaatgcatagatattacttagaacaccaattgcgaaggcaggtcactaagatttaactgacgctgatggacgaaagcgtggggagcgaacaggattagataccctggtagtccacgccgtaaacgatgctaactcgtttttggattttcggattcagagaccaagcgaaagtgataagttagccacctggggagtacgtccgcaaggatgaaactcaaaggaattgacgggggcccgcacaagcggtggattatgtggtttaattcgatgatacgcgaggaaccttaccaagacttaaatgggaattgacaggtctagaaatagaccctccttcgggcaatttccaaggtgctgcatggttgtcgtcagctcgtgccgtgaggtgttaggttaagtcctgcaacgagcgcaacccctgtcactagttgcyawcattyagttgrggactctagtgagactgcctacgcaagtagagaggaaggtggggatgacgtcaaatcatcacggcccttacgtcttgggccacacacgtaatacaatggccggtacagagggcagctaccaggtgactggatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaaaaggagctgcctagggtaaaacaggtaactagggctaagtcgtaacaaggtagcc

SEQ ID NO: 515 - DNA, 1519 bp, Chryseobacterium gleum
atacaatggagagtttgatcctggctcaggatgaacgctagcgggaggcctaacacatgcaagctgagcggtagagatctttcgggatcttgagagcggcgtacgggtgcggaacacgtgtgcaacctgcctttatcagggggatagcctttcgaaaggaagattaataccccataatatattgagtggcatcacttaatattgaaaactccggtggatagagatgggcacgcgcaagattagatagttggtgaggtaacggctcaccaagtctgcgatctttagggggcctgagagggtgatcccccacactggtactgagacacggaccagactcctacgggaggcagcagtgaggaatattggacaatgggtgcgagcctgatccagccatcccgcgtgaaggacgacggccctatgggttgtaaacttcttttgtatagggataaacctactctcgtgagagtagctgaaggtactatacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttgggctttcgggttcagagactaagcgaaagtgataagttagccacctggggagtacgaacgcaagtttgaaactcaaaggaattgacgggggcccgcacaagcggtggattatgtggtttaattcgatgatacgcgaggaaccttaccaaggcttaaatgggaaatgacaggcttagaaataggcttttcttcggacatttttcaaggtgctgcatggttgtcgtcagctcgtgccgtgaggtgttaggttaagtcctgcaacgagcgcaacccctgtcactagttgccatcattaagttggggactctagtgagactgcctacgcaagtagagaggaaggtggggatgacgtcaaatcatcacggcccttacgccttgggccacacacgtaatacaatggccggtacagagggcagctacactgcgaagtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattt

SEQ ID NO: 516 - DNA, 1483 bp, Chryseobacterium hominis
tttgatccctggctcaggatgaacgctagcgggaggcctaacacatgcaagccgagcggtatttgttcttcggaacagagagagcggcgcacgggtgcggaacacgtgtgcaacctgcctttatctgggggatagcctttcgaaaggaagattaataccccataatatattgagtggcatcatttgatattgaaaactccggtggatagagatgggcacgcgcaagattagatagttggtgaggtaacggctcaccaagtcaatgatctttagggggcctgagagggtgatcccccacactggtactgagacacggaccagactcctacgggaggcagcagtgaggaatattggacaatgggttagcgcctgatccagccatcccgcgtgaaggacgacggccctatgggttgtaaacttcttttgtatagggataaacctactctcgtgagagtagctgaaggtactatacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtaaatttgaagtggctggaataagtagtgtagcggtgaaatgcatagatattacttagaacaccaattgcgaaggcaggtcactaagatttaactgacgctgatggacgaaagcgtggggagcgaacaggattagataccctggtagtccacgccgtaaacgatgctaactcgtttttggggyttcggcttcagagactaagcgaaagtgataagttagccacctggggagtacgttcgcaagaatgaaactcaaaggaattgacgggggcccgcacaagcggtggattatgtggtttaattcgatgatacgcgaggaaccttaccaagacttaaatgggaaatgacagatttagaaatagatccttcttcggacatttttcaaggtgctgcatggttgtcgtcagctcgtgccgtgaggtgttaggttaagtcctgcaacgagcgcaacccctgtcactagttgctagcattaagttgaggactctagtgagactgcctacgcaagtagagaggaaggtggggatgacgtcaaatcatcacggcccttacgtcttgggccacacacgtaatacaatggccggtacagagggcagctacacagcgatgtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaaaaggagctgcctagggtaaaacaggtaactagggctaagtcgtaacaaggtagccgtacccga

SEQ ID NO: 517 - DNA, 1399 bp, Citrobacter amalonaticus
  modified_base (915)..(915): a, c, t, g, unknown or other
tcgacggtaacaggaagcagcttgctgctttgctgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagctagttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggggttaaggttaataaccttagccattgacgttacccgcagaagaagcaccggctaactccgtgccagcagccgcggtaatacggagggtgcaagcgttaatggaattactgggcgtaaagcgcacgcaggcggtctgtcaagtcggatgtgaaatccccgggctcaacctgggaactgcattcgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctatttggaggttgtgcccttgaggtgtggcttccggagctaacgcgttaaatagaccgcctggggagtacggccgcaaggttaaaactcaaatgaattgaagggggcccgcacaagcggtggagcatgtggtttaattcgatgcaagcgttaatnggatacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgc

SEQ ID NO: 518 - DNA, 1396 bp, Citrobacter braakii
  modified_base (940)..(940): a, c, t, g, unknown or other
  modified_base (976)..(976): a, c, t, g, unknown or other
tcgaacggtagcacagaggagcttgctccttgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttgtggttaataaccgcaacgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccanggaacttaccagagatggtttggtgccttcgggaancgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggag

SEQ ID NO: 519 - DNA, 1393 bp, Citrobacter farmeri
  modified_base (951)..(951): a, c, t, g, unknown or other
  modified_base (1369)..(1370): a, c, t, g, unknown or other
aacaggaagcagcttgctgctttgctgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggggatgtggttaataaccgcattcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaacttgtcagagatgccnaggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagnntagcttaaccttcgggagggcgc

SEQ ID NO: 520 - DNA, 1398 bp, Citrobacter freundii
  modified_base (19)..(19): a, c, t, g, unknown or other
  modified_base (1376)..(1381): a, c, t, g, unknown or other
tcgaacggtagcacagagngagcttgctccttgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggtgttgaggttaataacctcagcgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagnnnnnngcttaaccttcgggagg

SEQ ID NO: 521 - DNA, 1397 bp, Citrobacter gillenii
gtcgaacggtagcacagaggagcttgctccttgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggggatgtggttaataaccgcattcattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttagcagatatgctttagtgccttcgggaaccgtgagacaggtgctgcatggctgtcgtcagctcgagttgcgaagagttgggtaagaacccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggag

SEQ ID NO: 522 - DNA, 1387 bp, Citrobacter koseri
acaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaaaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcattgatactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttggcagagatgacttagatgcgtaaggcacgggctcaaccgtgctgcatggctgtcgtcagctcgtgttgtgaaatgtagaggggggtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaacctccgggagggc

SEQ ID NO: 523 - DNA, 1394 bp, Citrobacter murliniae
acggtagcacagaggagcttgctccttgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggtgttgtggttaataaccgcagcaattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaagtttgcagagatgcgaacgtgccttcgggagctctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggaggg

SEQ ID NO: 524 - DNA, 1542 bp, Citrobacter rodentium
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcccggtggagggggataactactggaaacggtagctaataccgcataacgtcgcaagaccaaagagggggaccttcgggcctcttgccaccggatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggattgtggttaataaccgcagtcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtctcgtagagggggggggaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctacttggaggttgtgcccctgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccactttgtgattcatgactggggtgaagtcgtaacaaggtaaccgtaggggaacctgcggttggatcacctcctta

SEQ ID NO: 525 - DNA, 1326 bp, Citrobacter sedlakii
cttgctctcgggtgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagcttgttggtgaggtaatggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgatgcggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtcacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcaca

SEQ ID NO: 526 - DNA, 967 bp, Citrobacter sp.
  30_2
  modified_base (8)..(10): a, c, t, g, unknown or other
  modified_base (762)..(762): a, c, t, g, unknown or other
  modified_base (776)..(776): a, c, t, g, unknown or other
  modified_base (926)..(926): a, c, t, g, unknown or other
  modified_base (940)..(940): a, c, t, g, unknown or other
  modified_base (945)..(945): a, c, t, g, unknown or other
gcacagannnagcttgctccttgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggtgttgaggttaataacctcagcaattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggangttgtgcccttgangcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacntccagagaacttancaganatgctttggtgccttcgggaac

SEQ ID NO: 527 - DNA, 1383 bp, Citrobacter sp.
  KMSI-3
  modified_base (926)..(927): a, c, t, g, unknown or other
  modified_base (934)..(934): a, c, t, g, unknown or other
  modified_base (948)..(948): a, c, t, g, unknown or other
  modified_base (964)..(964): a, c, t, g, unknown or other
  modified_base (1059)..(1059): a, c, t, g, unknown or other
  modified_base (1364)..(1364): a, c, t, g, unknown or other
gcacagagagcttgctctcgggtgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttgtggttaataaccttagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcacttggaggttgtgcccttgaggcgtggcttccggagctaacgcgttaagtcgaccgcctggggagtacggcgcaaggttaaaactcaaatgaattgacgggggcccgcacaagcggtggagcatgtggtttaattcgatgcaacgcgaagaaccttacctactcttgacatccanngaayttngcagagatgctttngtgccttcgggaactntgagacaggtgctgcatggctgtcgtcagctcgtgttgtgaaatgttgggttaagtcccgcaacgagcgcaacccttatcctttgttgccagcgnttcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagntagcttaaccttcgggagg

SEQ ID NO: 528 - DNA, 1022 bp, Citrobacter werkmanii
  modified_base (13)..(15): a, c, t, g, unknown or other
  modified_base (17)..(17): a, c, t, g, unknown or other
  modified_base (19)..(21): a, c, t, g, unknown or other
  modified_base (30)..(30): a, c, t, g, unknown or other
  modified_base (34)..(34): a, c, t, g, unknown or other
  modified_base (78)..(78): a, c, t, g, unknown or other
gtactttcagcgnnngnannngttgtggtnaatnaccgcagcaattgacgttactcgcagaagaagcaccgggctaantccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcggg

SEQ ID NO: 529 - DNA, 1266 bp, Citrobacter youngae
ttaaattgaagagtttgatcatggctcagattgaacgctggcggcaggcctaacacatgcaagtcgaacggtagcacagagagcttgctctcgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttgtggttaataaccgcagcgattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaagttttcagagatgagaacgtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcg

SEQ ID NO: 530 - DNA, 1436 bp, Cloacibacillus evryensis
cgcgtcgcgacgctggcggcgtgcctaacacatgcaagtcgaacgaagaccatagaggagcttgcgttaatatggttttagtggcggacgggtgagtaacgcgtgaggacttgtcgagtacagggggacaacaggtggaaacgtctgctaataccccataagccttcgggtaaaaggagcgatccggtacacgagagactcgcgttctatcagctagtaggtggggtaacggcccacccaggccaagacggatagccggactgagaggtcgatcggccacactggaactgagacacggtccagactcctacgggaggcagcagtggggaatattgggcaatgggggaaaccctgacccagcgacgccgcgtgagtgaagaaatccctcgggatgtaaaactctgttgtgtgggaagataatgacggtaccacacgaggaagccccggcaaactacgtgccagcagccgcggtaatacgtagggggcgagcgttgttcggaattactgggcgtaaagcgcacgcaggcggaccagtaagtctgtcgtcaaaggcggaggctcaaccttcgttccacgatagatactgcgggtctagagtatgtgagagggaagtggaattcccggtgtagcggtgaaatgcgtagatatcgggaggaacaccagtggcgaaggcggcttcctggcacacaactgacgctcatgtgcgaaagccagggcagcgaacgggattagataccccggtagtcctggccgtaaacgatggatactgggtgtgggtgaagcagttcatccgtgccgtagttaacgcgttaagtatcccgcctggggactacggtcgcaagactgaaactcaaaggaattgacgggggcccgcacaagcggtggagcacgtggtttaattcgatgcaaaccgaagaaccttacctgggtttgacatactaccggtactgacctgaaagggaagggaccccagcttgctggggaagtagaacaggtgctgcatggctgtcgtcagctcgtgtcgtgagatgttgggttaagtcccgcaacgagcgcaacccctatagccagttgctaacaagtgaagttgagcactctggcgagactgccgccgacaaggcggaggaaggtggggatgacgtcaagtcatcatggcctttatgcccagggcgacacacgtgctacaatggacggcacaaaaggcagcttactagcgatagttggcgaatcctaaaaagccgttcccagttcggattgcagtctgaaacccgactgcatgaagccggaatcgctagtaatcgcagatcagccaagctgcggtgaatacgttcccgggccttgtacacaccgcccgtcacaccacccgagttgggggcacccgaagccgcaggcttaacccgtaagggaaagaagcgtctaaggtgcgccgagtaagg

SEQ ID NO: 531 - DNA, 975 bp, Clostridiaceae bacterium END-2
  modified_base (738)..(738): a, c, t, g, unknown or other
  modified_base (856)..(856): a, c, t, g, unknown or other
  modified_base (917)..(917): a, c, t, g, unknown or other
  modified_base (926)..(926): a, c, t, g, unknown or other
  modified_base (946)..(946): a, c, t, g, unknown or other
  modified_base (952)..(952): a, c, t, g, unknown or other
  modified_base (954)..(954): a, c, t, g, unknown or other
  modified_base (958)..(958): a, c, t, g, unknown or other
  modified_base (967)..(969): a, c, t, g, unknown or other
gattatttcggtaagaagtactttatgactgagtggcggacgggtgagtaacgcgtggataacctgcctcatacagggggataacagttagaaatgactgctaataccgcataagcgcacagtgctgcatggcacagtgcgaaaagctccggcggtatgagatggatccgcgtttgattagctagttggtggggtaaaggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaattacgtgccagcagccgcggtaatacgtaaggggcaagcgttatccggatttactgggtgtaaagggagcgtagacggcagtgcaagtctgatgtgaaagcccggggctcaaccccgggactgcattggaaactgtgcagctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatactangtgtcgggcgccaaaggcgttcggtgccgcagcaaacgcaataagtattccacctggggagtacgttcgcaagaatgaaactcaaaggaattgacggggacccgcacaagcggtggancatgtggtttaattcgaagcaacgcgaagaaccttaccaagtcttgacatctgcctgaccnggtccgtanaggacccttccttcgggacnggcaananaggnggtgcatgnnngtcgtc

SEQ ID NO: 532 - DNA, 990 bp, Clostridiaceae bacterium JC13
  modified_base (896)..(896): a, c, t, g, unknown or other
  modified_base (904)..(904): a, c, t, g, unknown or other
  modified_base (924)..(924): a, c, t, g, unknown or other
  modified_base (934)..(934): a, c, t, g, unknown or other
  modified_base (942)..(942): a, c, t, g, unknown or other
  modified_base (968)..(968): a, c, t, g, unknown or other
  modified_base (970)..(970): a, c, t, g, unknown or other
  modified_base (983)..(984): a, c, t, g, unknown or other
gaagtgaagatagcttgctattggaacttagtggcgaacgggtgagtaacacgtagataacctgcctgtatgaccgggataacagttggaaacgactgctaataccggataggcagagaggaggcatctcttctctgttaaagttgggacacaacgcaaacagatggatctgcggtgcattagctagttggtgaggtaacggcccaccaaggcgatgatgcatagccggcctgagagggcgaacggccacattgggactgagacacggcccaaactcctacgggaggcagcagtagggaattttcggcaatgggggaaaccctgaccgagcaatgccgcgtgagtgaagacggccttcgggttgtaaagctctgttgtaagggaagaacggcatagagagggaatgctctatgagtgacggtaccttaccagaaagccacggctaactacgtgccagcagccgcggtaatacgtaggtggcaagcgttatccggaattattgggcgtaaagggtgcgtaggcggcgagataagtctgaggtaaaagcccgtggctcaaccacggtaagccttggaaactgtctggctggagtgcaggagaggacaatggaattccatgtgtagcggtaaaatgcgtagatatatggaggaacaccagtggcgaaggcggttgtctggcctgtaactgacgctgaagcacgaaagcgtggggagcaaataggattagataccctagtagtccacgccgtaaacgatgagaactaagtgttggggaaactcagtgctgcagttaacgcaataagttctccgcctggggagtatgcacgcaagtgtgaaactcaaaggaattgacgggggcccgcacaagcggtggagtatgtggtttaattcgacgcnacgcgaanaaccttaccaggccttgacntggtatcaanggccctanagatagggagatagttatggtacacncnggtggtgcatggnngtcgtc

SEQ ID NO: 533 - DNA, 1480 bp, Clostridiales bacterium 9400853
tagagtttgatcctggctcaggatgaacgctggcggcgtgcctaacacatgcaagtcgagcgagaagttactcaatgaatcttcggaagaattgagtaatggaaagcggcggacgggtgagtaacgcgtgggcaacctgcctttcacagagggatagccaaaggaaactttgattaaaacctcataaagccggaatagtgcataatataccggccaaagatttatcggtgaaagatgggcccgcgtctgattagctagttggtggggtaacggctcaccaaggcaacgatcagtagccgacctgagagggtgatcggccacattggaactgagacacggtccaaactcctacgggaggcagcagtggggaatattgcacaatgggcgcaagcttgatgcagcaacgccgcgtgaacgaagaaggccttcgggtcgtaaagttctgtccatagggaagaaacaaatgacggtacctatggaggaagccccggctaaatacgtgccagcagccgcggtaatacgtatggggcaagcgttatccggaattattgggcgtaaagagtgcgtaggtggtggcttaagcgcagggtttaaggcaatggcttaactattgttcgccttgcgaactgggtcacttgagtacaggagaggaaagcggaattcctagtgtagcggtgaaatgcatagatattaggaggaacaccggtggcgaaggcggctttctggactgcaactgacactgaggcacgaaagcgtgggtagcaaacaggattagataccctggtagtccacgccgtaaacgatgagcactaggtgtcggccaataaaggtcggtgccgcagttaacgcattaagtgctccgcctggggagtacgcacgcaagtgtaaaactcaaaggaattgacggggacccgcacaagcagcggagcatgtggtttaattcgaagcaacgcgaagaaccttaccagagcttgacatccctctgacagatccttaatcggattcttcttcggacagaggagacaggtggtgcatggttgtcgtcagctcgtgtcgtgagatgttgggttaagtcccgcaacgagcgcaacccttatcattagttgccatcattaagttgggcactctagtgagactgccggggacaactcggaggaaggtggggatgacgtcaaatcatcatgccccttatgttctgggctacacacgtgctacaatggtcggtacagaaagcagcgaaaccgtgaggtgaagccaatctccaaaaccgatctcagttcggattgtaggctgcaactcgcctacatgaagtcggagttgctagtaatcgcagatcagaatgctgcggtgaatgcgttcccgggtcttgtacacaccgcccgtcacaccatggaagttgggggtgcccgaagttggacaataaatcgtttacctaaggcaaaaccaatgactggggtgaagtcgtaacaaggtagccgta

SEQ ID NO: 534 - DNA, 1489 bp, Clostridiales bacterium 9403326
tagagtttgatcctggctcaggataaacgctggcggcgtgcgtaacacatgcaagtcgaacgagaatgtgctgacggatccttagggtgaagatagcacaggacagtggcggatgggtgagtaacgcgtaagaaacctgcctttcacaccgggatagcagctggaaacggctattaataccggatgacactttttccccgcatgaggaagaggttaaagaatttcggtgaaagatggtcttgcgtctgattagctagttggtggggtaacggcctaccaaggcgacgatcagtagccggcctgagagggtgtacggccacattgggactgagacacggcccaaactcctacgggaggcagcagtggggaattttgcacaatggaggaaactctgatgcagcgacgccgcgtgaacgaagaaggtcttcggattgtaaagttctgtcctgggtgaagataatgacggtaactcaggaggaagccccggctaactacgtgccagcagccgcggtaatacgtagggggcgagcgttgttcggaattattgggcgtaaagggtacgtaggcggtttgttaagtttggcgttaaatcacggggctcaaccccgttcagcgttgaaaactggcaaacttgagtagtagaggggacagtggaattcctagtgtagcggtgaaatgcgtagagattaggaagaataccggtggcgaaggcgactgtctggatacatactgacgctcaggtacgaaagcgtggggagcaaacaggattagataccctggtagtccacgccctaaacgatgagtgctaggtgtcgggtgtcaaagcccggtgccgccgttaacacattaagcactccgcctggggagtacgcacgcaagtgtgaaactcaaaggaattgacggggacccgcacaagtagcggagcatgtggtttaattcgaagcaacgcgaagaaccttaccagggcttgacataacagtgacgggttaagagattaaccgttcccttcggggacactgctacaggtggtgcatggttgtcgtcagctcgtgtcgtgagatgttgggttaagtcccgcaacgagcgcaacccttgtcgttagttgccagcattaagttggggactctagcgagactgccggtgataaaccggaggaaggtggggatgacgtcaaatcatcatgccctttatgtcctgggctacacacgtgctacaatggccgaaaacagcgtgaagcaacctcgtgagagcaagcgaaccacgaaaagtcggtctcagttcggactgtaggctgcaactcgcctacacgaagtcggagttactagtaatcgcgaatcagcatgtcgcggtgaatgcgttcccgggtcttgtacacaccgcccgtcacaccatggaagttggtaatacccgaagccgctgagcgaacctatgacgcaggcgtcgaaggtaggatcaatgactggggtgaagtcgtaacaaggtagccgta

SEQ ID NO: 535 - DNA, 1335 bp, Clostridiales bacterium SY8519
gagtttgatcctggctcaggatgaacgctggcggcgtgcctaacacatgcaagtcgaacgagtggcggacgggtgagtaacgcgtggataacctgcctcaaacagggggataacagccggaaacggctgctaataccgcataagaaaaagtggtttgagatggatccgcgtctgattagttagttggcggggtaacggcccaccaaggcgacgatcagtagccggcctgagagggtgaacggccacattgggactgagacacggcccagactcctacgggaggcagcagtggggaatattgcacaatgggggaaaccctgatgcagcaacgccgcgtgagcgaagaagtatttcggtatgtaaagctctatcagcagggaagatgacggtacctgactaagaagctccggctaaatacgtgccagcagccgcggtaatacgtatggagcaagcgttatccggatttactgggtgtaaagggagcgcaggcggtggcgcaagtctgatgtgaaaacccggggcccaaccccgggactgcattggaaactgcgtgacttgagtgtcggaggggtaagtggaattcctagtgtagcggtgaaatgcgtagatattaggaggaacaccagtggcgaaggcggcttactggacgaactgacgctgaggctcgaaagcgtggggagcaaacaggattagataccctggtagtccacgccgtaaacgatgaatactaggtgttggcatgtcagtgccgcagcaaacgcattaagtattccacctggggagtacgttcgcaagaatgaaactcaaaggaattgacggggacccgcacaagcggtggagcatgtggtttaattcgaagcaacgcgaagaaccttaccaggccttgacatcgacaggtggtgcatggttgtcgtcagctcgtgtcgtgagatgttgggttaagtcccgcaacgagcgcaacccttgtgtatagtagccagcggccgggcactctatacagactgccagggacaacctggaggaaggcggggatgacgtcaaatcatcatgccccttatggcctgggcgacacacgtgctacaatggcgtacagagggaggcraagccgcgaggtggagcgaatcccaaaacgtctcagttcggatgcaggctgcaacccgcctgcagaagctggaatcgctagtaatcgcagatcagcatgctgcggtgaatacgttcccgggtcttgtacacaccgcccgtcacaccatgggagtcggaaatgcccgaagccggtacccagggagccgtcgaaggcaggtctgataactggggtgaagtcgtaacaaggtagcc

SEQ ID NO: 536 - DNA, 1319 bp, Clostridiales bacterium oral clone P4PA_66 P1
gacgaacgctggcggcgcgcctaacacatgcaagtcgagcgagcggcggacgggtgagtaacgcgtgagcaacctaccttttacagggggataacgtcccgaaagggaccctaataccgcatgagcaaagccggtaaaagatgggctcgcgtccgattagatagttggtgaggtaacggcccaccaagtcaacgatcggtagccgacctgagagggtgatcggccacattggaactgagacacggtccagactcctacgggaggcagcagtggggaatattgggcaatgggggaaaccctgacccagcgacgccgcgtgaaggaagacggccttcgggttgtaaacttctgttcttggtgaagaagacggtaaccaaggaggaagccccggctaactacgtgccagcagccgcggtaatacgtagggggcgagcgttgtccggaatgattgggcgtaaagggcgcgtaggcggctacggaagtctggagtggaagtcctattttcaaggtaggaattgctttggaaactccgcagcttgagtgcaggagaggttatcggaattcccggtgtagcggtgaaatgcatagagatcgggaggaacaccagtggcgaaggcgggtaactggactgactgacgctgaggcgcgaaagtgtggggagcaaacaggattagataccctggtagtccacactgtaaacgatgaatgctaggtgtaggtgcatctgtgccgtcgtaaacacaataagcattccgcctggggagtacggtcgcaagattaaaactcaaaggaattgacgggggcccgcacaagcagcggagcatgtggtttaattcgaagcaacgcgaagaaccttaccaggtcttgacatcgacaggtggtgcatggatgtcgtcagctcgtgtcgtgagatgttgggttaagtcccgcaacgagcgcaacccttgccaatagttactaacggctgaggactctattgggactgccgtggacaacacggaggaaggtggggacgacgtcaaatcatcatgccccttatgacctgggctacacacgtgctacaatggtcgccaaagaggagcaaagccgcaaggcggagcggatctcaagcgatctcagttcagatgtgggctgcaacccgcccacagaagtcggagttgctagtaatcgcgaatcagcatgtcgcggtgaatacgttcccgggccttgtacacaccgcccgtcacaccatgggagttgatagcgcccgaaggcagaaggtagccatctgacgaaggcgagattaatgactggggtgaagtcgtaacagggtagccgta

SEQ ID NO: 537 - DNA, 1487 bp, Clostridiales bacterium oral taxon 093
gagtttgatcctggctcaggacgaacgctggcggcatgcttaacacatgcaagtcgaacgagctgattccttcgggatgaaagcgagtgcgaacgggtgagtaatgtatgagtaacctgcctctgtctacgggataacatttggaaacaagtgctaatacggtataagaccacagcaccgcatggtgcaggggtaaaagatttatcggacagagatggactcatatcccattagctagttggtgagataatagcccaccaaggcgacgatgggtagccgagctgagaggctgatcggccacattggaactgaaacacggtccagactcctacgggaggcagcagtggggaatattgggcaatggaggaaactctgacccagcaatgccgcgtgagcgatgaaggtcatcgattgtaaagctcttttcctgggaacgaaacaaatgacggtacccagggaataagccccggctaactacgtgccagcagccgcggtaatacgtagggggcgagcgttgtccggaatgactgggcgtaaagggtgcgtaggtggtttaataagttagaagtgtaatacccgggcttaactcgggtgctgcttctaaaactgttaggcttgagtgtagtagaggaaagcggaattcaatgtgtagcggtggaatgcgtagatatattgaagaacatcagtggcgaaggcggctttctggactataactgacactgaggcacgaaagcgtggggagcaaacaggattagataccctagtagtccacgccgtaaacgatggatactagatgcaggaggtattcactccttctgtgtcgcagctaacgcaataagtatcccgcctggggagtacgatcgcaagattaaaactcaaaggaattgacggggacccgcacaagcagcggaacatgtggtttaattcgaagcaacgcgaaaaaccttaccaagacttgacatcagtatgactatcatagaaatatggtatctcgcaagagcatactgacaggtggtgcatggttgtcgtcagctcgtgtcgtgagatgttaggttaagtcctgcaacgagcgcaacccttataactagttgccaatattaagttaggaactctagttagactgccgtggtcaacacggaggaaggtggggatgacgtcaaatcatcatgccccttacgtcttgggctacacacgtgctacaatggctattacaaagagttgcaagttggtaacagcaagctaatctcaaaaaaatagtctcagttcggattgtgggctgcaacccgcccacatgaagtcggagttgctagtaatcccgaatcagcatgtcggggtgaatgcgttcccgggtcttgtacacaccgcccgtcacgccatgggagttggtagtacccaaagtcggtgagctaaccgcaaggaagcagccgcctaaggtaagatcaatgactggggtgaagtcgtaacaaggtagccgtatcggaaggtgc

SEQ ID NO: 538 - DNA, 1532 bp, Clostridiales bacterium oral taxon F32
agagtttgatcctggctcaggataaacgctggcggcgcacataagacatgcaagtcgaacgaaagtcgttgtatatgaaattgactaagaatttagatttatctagaagatgagaatgtagattatacaacaatggctttagtggcggactggtgagtaatacgtaagcaacctgcctattagaggggaataacaattagaaatgattgataataccgcatatgccatagtcatcacatgatgatagtgggaaaggagtaatccgctgatagatgggcttacgcctgattagatagttggtagggtaatggcctaccaagtctgcgatcagtagccgaactgagaggttgaacggccacattgggactgagatacggcccagactcctacgggaggcagcagtcgggaatattgcgcaatggaggaaactctgacgcagtgacgccgcgtgcaggaagaaggttttcggattgtaaactgctttagacagggaagataaaagacagtacctgtaaaataagctccggctaactacgtgccagcagccgcggtaatacgtagggagcgagcgttatccggatttattgggtgtaaagggtgcgtagacgggaaattaagttatttgtgaaatccctcggcttaaccgaggaactgcaactaaaactgattttcttgagtattggagaggaaagtggaattcctagtgtagcggtgaaatgcgtagatattaggaggaacaccagtggcgaaggcgactttctggacaataactgacgttgaggcacgaaagtgtggggagcaaacaggattagataccctggtagtccacactgtaaacgatggatactaggtgtagggtgtgataaacgctctgtgccgtcgctaacgcagtaagtatcccacctggggagtacgaccgcaaggttgaaactcaaaggaattgacgggggcccgcacaagcagtggagtatgtggtttaattcgacgcaacgcgaagaaccttaccagggcttgacatatacaggaatatgctagagatagtatagctcttcggagcctgtatacaggtggtgcatggttgtcgtcagctcgtgtcgtgagatgttgggttaagtcccgcaacgagcgcaacccctatctttagttaccagcgagtaatgtcgggaactctagagagactgccggtgttaaatcggaggaaggtggggacgacgtcaaatcatcatgccctttatgtcctgggctacacacgtactacaatggctattacaaagggaagcaatacagcaatgtggagcaaaactcaaaaaaatagtctcagttcggattgaaggctgaaattcgccttcatgaagctggaattgctagtaatggcaggtcagcatactgccgtgaatacgttcccgggccttgtacacaccgcccgtcacaccatgagagttggggatacccgaagcctgtgagctaacttttagaggcagcagtcgaaggtagaatcaatgattggggtgaagtcgtaacaaggtagccgt

SEQ ID NO: 539 - DNA, 1474 bp, Clostridiales bacterium ph2
tggctcaggattaacgctggcggcgtgcataacacatgcatgttgaacgagaatctctttgacagatccttcgggtgacgacagagagaggaaagtagcggatgggtgagtaacacgtaaggaacctgccatgcacagggggatagcagccggaaacgactattaataccccatgacacctcactttcgcatgaaagagaggtcaaagatttatcggtgtgtgatggccttgcgtctgattagcttgttggtggggtaaaggcctaccaaggcgatgatcagtagccggcttgagagagtgtacggccacattgggattgagacacggcccagactcctacgggaggcagcagtggggaattttgcacaatggaggaaactctgatgcagcgacgccgcgtgaacgaagaaggtcttcggattgtaaagttctgtcctggacgaagataatgacggtaatccaggaggaagccccggctaactacgtgccagcagccgcggtaatacgtagggggcgagcgttgtccggaatgattgggtgtaaagggtacgcaggcggtctattaagtttgacgtgaaagcccggggctcaacctcggcaagcgttgaaaactggtagacttgaatagtggaagggacagtggaattcctagtgtagcggtgaaatgcgtagagattaggaagaataccaatggcgaaagcaactgtctggacacatattgacgctgaggtacgaaagcgtggggagcaaacaggattagataccctggtagtccacgccgtaaacgctgagtgctaggtgttgggggtcaaacctcggtgccgacgttaacacattaagcactccacctggggagtacgcacgcaagtgtgaaactcaaaggaattgacggggacccgcacaagtagcggagcatgtggtttaattcgacgcaacgcgaagaaccttaccaaggcttgacataaaacggaccggtgtagagatacaccytctcttcggagctgttttacaggtggtgcatggttgtcgtcagctcgtgttgtgaaatgttgggttaagtcccgcaacgagcgcaacccctgtcgttagttaccagcaagtaaagttggggactctaacgagactgccggtgataaaccggaggaaggtggggacgacgtcaaatcatcatgccctttatgtcttgggctacacacgtgctacaatggttgggaacaaagcgcagcaaggtcgcgaggccaagcgaatcgcagaaaaccaatctcagttcggattggaggctgcaacccgcctccatgaagtcggagttactagtaatcgtggatcagcatgccacggtgaatgcgttcccgggtcttgtacacaccgcccgtcacaccatggaagttggtaatacccgaagtcgctgagcgaaccgcaaggaagcaggcgccgaaggtaggatcaatgactggggtgaagtcgtaacaagta

SEQ ID NO: 540 - DNA, 1523 bp, Clostridiales sp.
  BVAB3
agagtttgatcctggctcaggatgaacgctggcggcgtgcttaacacatgcaagtcgaacggagctttgaggaagtgcttgcacagaattaaagcttagtggcggacgggtgagtaacgcgtgaggaacctgcctttcacagtggaataacaacgggaaaccgttgctaatggcgcatgacatcgcattgaggcatctcagagcgattaaaggagaaatccggtgaaagatggactcgcgtccgattagctagttggtgaggtaacggcccaccaaggcgacgatcggtagccgaactgagaggttgatcggccacattgggactgagacacggcccagactcctacgggaggcagcagtggggaatattgggcaatgggcgaaagcctgacccagcaacgccgcgtgaagtatgaaggccttcgggttgtaaacttctttgatcagggaagaaacaaatgacggtacctgaaaaacaagccacggctaactacgtgccagcagccgcggtaatacgtaggtggcgagcgttatccggatttactgggtgtaaagggcgtgcaggcgggctgataagtcagatgtgaaatccccgagcttaactcgggaactgcatctgatactgttggtcttgagtgctggagaggatagtggaattcctagtgtagcggtaaaatgcgcagatattaggaggaacaccagtggcgaaggcggctatctggacagtaactgacgctgaggcgcgaaagcgtgggtagcaaacaggattagataccctggtagtccacgccgtaaacgatgattactaggtgtaggaggtatcgaccccttctgtgccggagttaacacaataagtaatccacctggggagtacggccgcaaggttgaaactcaaaggaattgacgggggcccgcacaagcagtggagtatgtggtttaattcgacgcaacgcgaagaaccttaccagggtttgacatcccttgaacgatgtagagatacataattcccttcggggacaaggagacaggtggtgcatggttgtcgtcagctcgtgtcgtgagatgttgggttaagtcccgcaacgagcgcaacccctattgccagttgccatcatttagttgggcactcaggcgagactgccgttgataaaacggaggaaggtggggatgacgtcaaatcatcatgccccttatatcctgggctacacacgtactacaatggctacaacagagagcagcgacgtcgcgaggcgaagcaaatccccaaatgtagtctcagttcggattgcaggctgcaactcgcctgcatgaagccggaattgctagtaatggcaggtcagcatactgccgtgaatacgttctcgggccttgtacacaccgcccgtcacaccatgagagtcagtaacacccgaagtcagtagtctaaccgcaagggggacgctgccgaaggtgggaccgataattggggtgaagtcgtaacaaggtagccgtatcggaaggtgcggctggatcacctcctttct

SEQ ID NO: 541 - DNA, 1020 bp, Clostridiales bacterium 1_7_47FAA
  modified_base (14)..(15): a, c, t, g, unknown or other
  modified_base (969)..(969): a, c, t, g, unknown or other
  modified_base (974)..(974): a, c, t, g, unknown or other
  modified_base (977)..(977): a, c, t, g, unknown or other
  modified_base (983)..(985): a, c, t, g, unknown or other
gaacgaagcatccnnataggaagttttcggatggaatatgggatgactgagtggcggacgggtgagtaacgcgtggataacctgcctcacactgggggataacagttagaaatggctgctaataccgcataagcgcacagtaccgcatggtacggtgtgaaaaacccaggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctgaagtgaaagcccggggctcaaccccgggactgctttggaaactgtgtggctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatgctaggtgtcggggggcaaagcccctcggtgccgccgctaacgcaataagcattccacctggggagtacgttcgcaagaatgaaactcaaaggaattgacggggacccgcacaagcggtggagcatgtggtttaattcgaagcaacgcgaagaaccttaccaagtcttgacatccccctgaccggacagtaacgtgtcccttccttcgggacaggganacagnggngcatgnnntcgtcagctcgtgtcgtgagatgttgggttaagtc

SEQ ID NO: 542 - DNA, 1435 bp, Clostridiales sp.
  SM4/1
gacgaattgactgagtggcggacgggtgagtaacgcgtgggtaacctgcctcacactgggggacaacagctggaaacggctgctaataccgcataagcgcacagcttcgcatgaagcagtgtgaaaaactccggtggtgtgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaagcccggggctcaaccgcgggactgctttggaaactgttttgctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttggtgagcaaagctcatcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggaacttaaccgttccttttcttcggaacattccagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagggaagcgaagctgtgaagctgagcaaatctcaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagtcagtaacgcccgaagtcagtgacccaaccgcaaggagggagctgccgaaggcgggaccgataactggggtgaagtcgtaacaaggtagccgtatcggaaggtgcggctggatcacctcctttct

SEQ ID NO: 543 - DNA, 1297 bp, Clostridiales sp.
  SS3/4
gatgaacgctggcggcgtgcctaacacatgcaagtcgaacgagtggcggacgggtgagtaacgcgtgggtaacctgcctcatacagggggataacggttagaaatgactgctaataccgcataagaaaaagtggtatgagatggacccgcgtctgattagctagttggtggggtaacggcccaccaaggcgacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagatgacggtacctgactaagaagccccggctaactacgtgccagcagccgcggtaatacgtagggggcaagcgttatccggatttactgggtgtaaagggagcgtagacggcgacgcaagtctgaagtgaaatacccgggctcaacctgggaactgctttggaaactgtgttgctagagtgctggagaggtaagcggaattcctagtgtagcggtgaaatgcgtagatattaggaagaacaccagtggcgaaggcggcttactggacagactgacgttgaggctcgaaagcgtggggagcaaacaggattagataccctggtagtccacgccgtaaacgatgaatactaggtgttggtgcatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatcgacaggtggtgcatggttgtcgtcagctcgtgtcgtgagatgttgggttaagtcccgcaacgagcgcaacccctattgtcagtagccagcagctgggcactctgatgagactgccagggataacctggaggaaggtggggatgacgtcaaatcatcatgccccttatgatttgggctacacacgtgctacaatggcgtacaaagagaagcgagcctgcgagggggagcaaatctcaaaacgtctcagttcggatgtagtctgcaactcgactacagaagctggaatcgctagtaatcgcagatcagaatgctgcggtgaatacgttcccgggtcttgtacacaccgcccgtcacaccatgggagtcggaaatgcccgaagccagtacccagggagctgtcgaaggcaggtctgataactggggtg

SEQ ID NO: 544 - DNA, 1378 bp, Clostridiales sp.
  SSC/2
  modified_base (13)..(13): a, c, t, g, unknown or other
ccttatttgattnttcttcggaactgaagatttggtgattgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactgagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccgggcgtttgcgtcgggacaggagtgacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggaggga

SEQ ID NO: 545 - DNA, 1510 bp, Clostridium acetobutylicum
tttaaattgagagtttgatcctggctcaggacgaacgctggcggcgtgcttaacacatgcaagtcgagcggggaacttcggttcccagcggcggacgggtgagtaacacgtgggtaacctacctcatagtggggaatagcctttcgaaaggaagattaataccgcataatactcgagaatcgcatgattcttgagccaaaggatttattcgctatgagatggacccgcggcgcattagcttgttggtgaggtaacggctcaccaaggcttcgatgcgtagccgacctgagagggtgatcggccacattggaactgagacacggtccagactcctacgggaggcagcagtggggaatattgcacaatgggggaaaccctgatgcagcaacgccgcgtgagtgatgaaggtcttcggatcgtaaaactctgtcttatgggacgataatgacggtaccataggaggaagccacggctaactacgtgccagcagccgcggtaatacgtaggtggcaagcgttgtccggatttactgggcgtaaaggatgtgtaggcggatatttaagtgagatgtgaaatccccgggcttaacttgggggctgcatttcaaactggatgtctggagtgcaggagaggaaggcagaattcctagtgtagcggtgaaatgcgtagagattaggaagaataccagtggcgaaggcggccttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctgggaagtacggtcgcaagattaaaactcaaaggaattgacggggacccgcacaagcagcggagcatgtggtttaattcgaagcaacgcgaagaaccttacctagacttgacatctcctgaattagtccgtaatggatgaagtcccttcggggacaggatgacaggtggtgcatggttgtcgtcagctcgtgtcgtgagatgttgggttaagtcccgcaacgagcgcaacccttatcattagttgctaacatttagttgagcactctagtgagactgcccgggttaaccgggaggaaggtggggatgacgtcaaatcatcatgccccttatgtctagggctacacacgtgctacaatggtggggacaaaaagatgcaataccgcaaggtggagcaaaactcaaaaccccatcccagttcggattgtaggctgaaactcgcctacatgaagccggagttgctagtaatcgcgaatcagaatgtcgcggtgaatacgttcccgggtcttgtacacaccgcccgtcacaccatgagagtcggcaacacccgaagcccgtgaggtaaccttttggaaccagcggtcgaaggtggggttgataattggggtgaagtcgtaacaaggtagccgtaggagaacctgcggctggatcacctcctttct

SEQ ID NO: 546 - DNA, 1470 bp, Clostridium aerotolerans
  modified_base (1082)..(1083): a, c, t, g, unknown or other
  modified_base (1085)..(1089): a, c, t, g, unknown or other
cgcgtgcttaacacatgcaagtcgagcgaagcattttaaaggaagttttcggatggaatttaagatgacttagcggcggacgggtgagtaacgcgtgggtaacctgcctcatacagggggataacagttagaaatgactgctaataccgcataagcgcacagtgctgcatagcacagtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggctctgcaagtctggagtgaaagccggggctcaaccccgggactgctttggaaactgtggagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccgtctcgtaacggagacctcccttcggggcattccagacaggtggtgcatggttgtcgtcagctcgtgtcgtgagatgttgggttaagtcccgcaacgagcgcaacccttatccttagtagccagcanntnnnnntgggcactctggggagactgccagggataacctggaggaaggtggggatgacgtcaaatcatcatgccccttatgatttgggctacacacgtgctacaatggcgtaaacaaagggaagcaaaggagcgatctggagcaaatcccaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaagg

SEQ ID NO: 547 - DNA, 1289 bp, Clostridium aldenense
  modified_base (139)..(139): a, c, t, g, unknown or other
  modified_base (676)..(676): a, c, t, g, unknown or other
ggtgagtaacgcgtggataacctgcctcacactgggggataacagttagaaatggctgctaataccgcataagcgcacagtaccgcatgggacggtgtgaaaaacccaggtggtgtgagatggatccgcgtctgattanccagttggcggggtaacggcccaccaaagcgacgatcagtagccgacctgagagggtgaccggccacattgggactgagacacggcccaaactcctacgggaggcagcagtggggaatattgcacaatgggcgcaagcctgatgcagcgacgccgcgtgagtgaaaaaatatctcggtatgtaaagctctatcagcaggaaaaaggataaaaacccggctaactacgtgccagcagccgcggtaatacgtagggggcaagcgttatccggatttactgggtgtaaagggagcgtagacggcgacgcaagtctggagtgaaagcccggggcccaaccccgggactgctttggaaactgtgctgctggagtgcagagaggtaagtggaattcctagtgtacggtgaaatgcgtaatattagaggaacaccagtggcgaaggcggcttactggactgtaactgacgttgaggctcgaaagcgtggggagcaaacaggattagataccctggtagtccacgccgtaaacgatgaatgctangtgtcggggggcaaagcccttcggtgccgccgctaacgcaataagcattccacctggggagtacgttcgcaagaatgaaactcaaaggaattgaccgggacccgcacaagcggtggaccatgtgctttaattcgaaacaacgcgaaaaaccttaccaagtcttgacatccccctgaccggtccgtaacggggcctttccttcgggacaggggagacaggtggtgcatggttgtcgtcagctcgtgtcgtgagatgttgggttaagtcccgcaacgagcgcaacccttatccttagtagccagcacgtcgtggtgggcactctagggagactgccagggataacctggaggaaggtggggatgacgtcaaatcatcatgccccttatgatttgggctacacacgtgctacaatggcgtaaacaaagggaggcgaccctgcgaaggtaagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagcaacgcccgaagtcagtg

SEQ ID NO: 548 - DNA, 1482 bp, Clostridium aldrichii
  modified_base (47)..(47): a, c, t, g, unknown or other
  modified_base (145)..(145): a, c, t, g, unknown or other
  modified_base (367)..(367): a, c, t, g, unknown or other
  modified_base (946)..(946): a, c, t, g, unknown or other
cggcgtgcttaacacatgcaagtcgagcggaaatacattgaagattnatcggatatgtattttagcggcggacgggtgagtaacgcgtgggcaatctgcctcacacaggggaataacactgggaaactagtgctaataccgcatnatatagtgaagtggcatcactttactatcaaaggagcaatccggtgtgagatgagcccgcgtccgattagctagttggtggggtaacggcccaccaaggcgacgatcggtagccgaactgagaggttgatcggccacattgggactgagacacggcccagactcctacgggaggcagcagtggggaatattgcgcaatgggggaaaccctgacgcagcaacnccgcgtgaaggatgaaggttttcggattgtaaacttctttgattggggacgataatgacggtacccaaaaaacaagccacggctaactacgtgccagcagccgcggtaatacgtaggtggcaagcgttgtccggaattactgggtgtaaagggcgtgtaggcggggatgcaagtcagatgtgaaattccgaagctcaacttcggcgctgcatctgaaactgtatctcttgagtgctggagaggaaagcggaattcctagtgtagcggtgaaatgcgtagatattaggaggaacaccagtggcgaaggcggctttctggacagtaactgacgctgaggcgcgaaagcgtggggagcgaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacataccantgacgtacttagagataggtattcccttcgggacaatggatacaggtggtgcatggttgtcgtcagctcgtgtcgtgagatgttgggttaagtcccgcaacgagcgcaacccctgttgttagttgccatcattaagttgggcactctagcgagactgccggtgacaaatcggaggaaggtggggacgacgtcaaatcatcatgccccttatgtcctgggctacacacgtactacaatggctattacagagggaagcgaagccgcgaggtggagcaaatctccaaaaatagtcccagttcagattgcaggctgaaactcgcctgcatgaagtcggaattgctagtaatggcaggtcagcatactgccgtgaatacgttcccgggccttgtacacaccgcccgtcacaccatgagagtctgcaacacccgaagtcagtagtctaactgtaaagaggacgctgccgaaggtggggccgatgattggggtgaagtcgtaacaaggtagccgtatcggaaggtgcggctggatcacctcct

SEQ ID NO: 549 - DNA, 1481 bp, Clostridium algidicarnis
agagtttgatcctggctcaggacgaacgctggcggcgtgcttaacacatgcaagtcgagcgaagttattccttcggggataacttagcggcggacgggtgagtaacacgtgggtaacctgcctcatagagggggatagccttccgaaaggaagattaataccccataacatagcattatcgcatgataaagttattaaaggagtaatccgctatgagatggacccgcggcgcattagctagttggtgaggtaacggctcaccaaggccacgatgcgtagccgacctgagagggtgatcggccacattgggactgagacacggcccagactcctacgggaggcagcagtggggaatattgcacaatgggcgaaagcctgatgcagcaacgccgcgtgagtgatgaaggccttcgggtcgtaaagctctgtcttcggggacgataatgacggtacccgaggaggaagccacggctaactacgtgccagcagccgcggtaatacgtaggtggcaagcgttgtccggatttactgggcgtaaagggagcgtaggcggatacttaagtgggatgtgaaatacccgggctcaacccgggtgctgcattccaaactgggtatctagagtgtgggagaggaaagtggaattcctagtgtagcggtgaaatgcgtagagattaggaagaacaccagtggcgaaggcgactttctggaccataactgacgctgaggctcgaaagcgtggggagcaaacaggattagataccctggtagtccacgccgtaaacgatggatactaggtgtgggggataccaatcctccgtgccgtcgttaacacactaagtatcccgcctggggagtacgatcgcaagattaaaactcaaaggaattgacgggggcccgcacaagcagcggagcatgtggtttaattcgaagcaacgcgaagaaccttacctagacttgacatctcctgaattacctgtaattagggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcctgggttaaccaggaggaaggtggggatgacgtcaaatcatcatgccccttatgtctagggctacacacgtgctacaatggcgagtacaacgagatgcaatatcgtgaggtggagcaaaactcaaaaaactcgtcccagttcggattgtaggctgaaactcgcctacatgaagccggagttgctagtaatcgcgaatcagaatgtcgcggtgaatacgttcccgggccttgtacacaccgcccgtcacaccatgagagttggcaatacccgaagtccgtgcgctaacgcgtaagcgaggcagcggccgaaggtagggtcagcgattggggtgaagtcgtaacaaggtagccgtaggaga

SEQ ID NO: 550 - DNA, 1502 bp, Clostridium algidixylanolyticum
agagtttgatcctggctcaggatgaacgctggcggcgtgcttaacacatgcaagtcgagcgaagcgattttaaggaagccttcgggtggaattagaattgacttagcggcggacgggtgagtaacgcgtgggtaacctgcctcatacagggggataacagttagaaatgactgctaataccgcataagcgcacagtgctgcatagcacagtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgactgaagaagtatttcggtatgtaaaggtctatcagcagggaagaaaatgacggtacctgactaagaagccccggctaactacgtgccagcagccgcggtaatacgtagggggcaagcgttatccggatttactgggtgtaaagggagcgtagacggctctgcaagtctggagtgaaagcccggggctcaaccccgggactgctttggaaactgtggagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgtcggggagcaaagctcttcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgacagccttataactaaggtctccctacggggcattctagacaggtggtgcatggttgtcgtcagctcgtgtcgtgagatgttgggttaagtcccgcaacgagcgcaacccttatccttagtagccagcagttcggctgggcactctggggagactgccagggataacctggaggaaggtggggatgacgtcaaatcatcatgccccttatgatttgggctacacacgtgctacaatggcgtaaacaaagggaagcgaaggagcgatctggagcaaaccccaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaga

SEQ ID NO: 551 - DNA, 1454 bp, Clostridium aminovalericum
  modified_base (465)..(466): a, c, t, g, unknown or other
  modified_base (572)..(573): a, c, t, g, unknown or other
  modified_base (774)..(774): a, c, t, g, unknown or other
ttaacacatgcaagtcaacggagttaatcaagcgcgaagtcttcggatggaagcttgttaacttagtggcggacgggtgagtaacgcgtgggtaacctgccttatacagggggataacagccggaaacggttgctaataccgcataagcatacagtgccgcatggtacagtgtgaaaaagattaagttcaacttcgttcaactctggtataagatggacccgcgtctgattagctagttggtgaggtaatggctcaccaatggcgacgatcagtagccggcttgagagagtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggacgataatgacggtacctgactaagaagccnnggctaactacgtgccagcagccgcggtaatacgtagggggcaagcgttatccggatttactgggtgtaaagggagcgtagacggtctggtaagtcaggtgtgaaanncccggggctcaaccccggattgcacttgaaactacccgactagagtgcaggagaggtaagtggaattcctagtgtagcggtgaaatgcgtagatattaggaggaacaccagtggcgaaggcggcttactggactgtaactgacgttgaggctcgaaagcgtggggagcgaaacaggattagataccctggtagtccacgcngtaaacgatgaatactaggtgttggggtccataaggacttcggtgccgtcgcaaacgcaataagtattccacctggggagtacgttcgcaagaatgaaactcaaaggaattgacggggacccgcacaagcgtgggagcatgtggtttaattcgaagcaacgcgaagaaccttaccaggtcttgacatccctctgaccggtccgtaatgggacctttccttcgggacagaggaacaggtggtgcatggttgtcgtcagctcgtgtcgtgagatgttgggttaagtcccgcaacgagcgcaacccctatctttagtagccagcagttcggctgggcactctagagagactgccagggataacctggaggaaggcggggatgacgtcaaatcatcatgccccttatgatctgggctacacacgtgctacaatggtgactacaaagagaagcaaagctgtgaagtggagccaatctcaaaaaggtcatctcagttcggattgtagtctgcaactcgactacatgaagctggaatcgctagtaatcgcagatcagaatgctgtggtgaatacgttcccgggtcttgtacacaccgcccgtcacaccatgggagttggatatgcccgaagtcagtgacccaaccgtaaggagggagctgccgaaggtggagccaatgactggggtg

SEQ ID NO: 552 - DNA, 1485 bp, Clostridium amygdalinum
ctcaggatgaacgctggcggcgtgcttaacacatgcaagtcgagcgaagcagttttaaggaagttttcggatggaattaaaattgactgagcggcggacgggtgagtaacgcgtgggtaacctgcctcatacagggggataacagttggaaacgactgctaataccgcataagcgcacagtgctgcatggcacggtgtgaaaaactccggtggtatgagatggacccgcgtctgattaggtagttggtggggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgactgaagaagtatttcggtatgtaaaggtctatcagcagggaagaaaatgacggtacctgactaagaagccccggctaactacgtgccagcagccgcggtaatacgtagggggcaagcgttatccggatttactgggtgtaaagggagcgtagacggcgatgcaagtctggagtgaaagcccggggctcaaccccgggactgctttggaaactgtgttgctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggtccgtaacggggccttcccttcggggcattccagacaggtggtgcatggttgtcgtcagctcgtgtcgtgagatgttgggttaagtcccgcaacgagcgcaacccttatccttagtagccagcagtacggctgggcactctggggagactgccagggataacctggaggaaggtggggatgacgtcaaatcatcatgccccttatgatttgggctacacacgtgctacaatggcgtaaacaaagggaagcgaaggagtgatccggagcaaatctcaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcgga

SEQ ID NO: 553 - DNA, 1504 bp, Clostridium argentinense
agagtttgatcctggctcaggacgaacgctggcggcgtgcctaacacatgcaagtcgagcgatgaagcttccttcgggaagtggattagcggcggacgggtgagtaacacgtgggtaacctgcctctaagaggggaatagcctcccgaaagggagattaataccgcataaagtatgaaggtcgcatgacttttataccaaaggagtaatccgctatgagatggacccgcggcgcattagctagttggtgaggtaagggctcaccaaggcaacgatgcgtagccgacctgagagggtgatcggccacattggaactgagacacggtccagactcctacgggaggcagcagtggggaatattgcgcaatgggggaaaccctgacgcagcaacgccgcgtgaatgaagaaggccttagggttgtaaagttctgtcatatgggaagataatgacggtaccatatgaggaagccacggctaactacgtgccagcagccgcggtaatacgtaggtggcaagcgttgtccggatttactgggcgtaaaggatgcgtaggcggacatttaagtcagatgtgaaatacccgggctcaacttgggtgctgcatttgaaactgggtgtctagagtgcaggagaggaaagcggaattcctagtgtagcggtgaaatgcgtagagattaggaagaacaccagtggcgaaggcggctttctggactgtaactgacgctgaggcatgaaagcgtggggagcaaacaggattagataccctggtagtccacgccgtaaacgatgaatactaggtgtaggaggtatcgaccccttctgtgccgcagttaacacaataagtattccgcctggggagtacgatcgcaagattaaaactcaaaggaattgacgggggcccgcacaagcagcggagcatgtggtttaattcgaagcaacgcgaagaaccttacctagacttgacatcccctgaattacctgtaatgagggaagcccttcggggcagggagacaggtggtgcatggttgtcgtcagctcgtgtcgtgagatgttgggttaagtcccgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggttggtacaacaagatgcaagaccgcgaggtggagctaaacttaaaaaaccaacccagttcggattgtaggctgaaactcgcctacatgaagccggagttgctagtaatcgcgaatcagcatgtcgcggtgaatacgttcccgggccttgtacacaccgcccgtcacaccatgagagctggtaacacccgaagtccgtgaggtaaccgtaaggagccagcgccgaaggtgggattagtgattggggtgaagtcgtaacaaggtagccgtaggagaacctgcggttggatcacctcctt

SEQ ID NO: 554 - DNA, 1387 bp, Clostridium asparagiforme
tcgaacgaagcattttagatgaagttttcggatggattctgagatgactgagtggcggacgggtgagtaacacgtggataacctgcctcacactgggggacaacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaaaaaccttaccaagtcttgacatcctcttgaccggcgtgtaacggcgcctttccttcgggacaagagagacaggtggtgcatggttgtcgtcagctcgtgtcgtgagatgttgggttaagtcccgcaacgagcgcaacccttatccttagtagccagcattaagatgggcactctagggagactgccagggacaacctggaggaaggtggggatgacgtcaaatcatcatgccccttatgatttgggctacacacgtgctacaatggcgtaaacaaagggaagcgaccctgcgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggaggga

SEQ ID NO: 555 - DNA, 1508 bp, Clostridium baratii
gagagtttgatcctggctcaggacgaacgctggcggcgtgcctaacacatgcaagtcgagcgatgaagtttccttcgggaaacggattagcggcggacgggtgagtaacacgtgggtaacctgcctcatagaggggaatagcctcccgaaagggagattaataccgcataacattgcagtttcgcatgaaacagcaattaaaggagcaatccgctatgagatggacccgcggcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttggggacgataatgacggtacccaaggaggaagccacggctaactacgtgccagcagccgcggtaatacgtaggtggcgagcgttgtccggatttactgggcgtaaagggagcgtaggcggatttttaagtgggatgtgaaatacccgggctcaacctgggtgctgcattccaaactgggaatctagagtgcaggaggggagagtggaattcctagtgtagcggtgaaatgcgtagagattaggaagaacaccagtggcgaaggcgactctctggactgtaactgacgctgaggctcgaaagcgtggggagcgaacaggattagataccctggtagtccacgccgtaaacgatgaatactaggtgtaggggtttcaacacctctgtgccgccgctaacgcattaagtattccgcctggggagtacggtcgcaagattaaaactcaaaggaattgacgggggcccgcacaagtagcggagcatgtggtttaattcgaagcaacgcgaagaaccttacctagacttgacatcctctgcattacccttaatcggggaagttccttcgggaacagagtgacaggtggtgcatggttgtcgtcagctcgtgtcgtgagatgttgggttaagtcccgcaacgagcgcaacccctattgttagttgctaccattaagttgagcactctagcgagactgcctgggttaaccaggaggaaggtggggatgacgtcaaatcatcatgccccttatgtctagggctacacacgtgctacaatggcaagtacagagagatgctataccgcgaggtggagctaaacttcaaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagttcgtgagctaacgcgtaagcgaggcagcgacctaaggtagggtcagcgattggggtgaagtcgtaacaaggtagccgtaggagaacctgcggctggatcacctcctt

SEQ ID NO: 556 - DNA, 1364 bp, Clostridium bartlettii
tcgagcgattctcttcggagaagagcggcggacgggtgagtaacgcgtgggtaacctgccctgtacacacggataacataccgaaaggtatgctaatacgggataacataagaaattcgcatgtttttcttatcaaagctccggcggtacaggatggacccgcgtctgattagctagttggtgaggtaatggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggatttactgggcgtaaagggtgcgtaggcggtcttttaagtcaggagtgaaaggctacggctcaaccgtagtaagctcttgaaactggaggacttgagtgcaggagaggagagtggaattcctagtgtagcggtgaaatgcgtagatattaggaggaacaccagtagcgaaggcggctctctggactgtaactgacgctgaggcacgaaagcgtggggagcaaacaggattagataccctggtagtccacgccgtaaacgatgagtactagctgtcggaggttacccccttcggtggcgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatctttcccttcggggacagaagtgacaggtggtgcatggttgtcgtcagctcgtgtcgtgagatgttgggttaagtcccgcaacgagcgcaacccttgcctttagttgccatcattaagttgggcactctagagggactgccagggataacctggaggaaggtggggatgacgtcaaatcatcatgccccttatgcttagggctacacacgtgctacaatgggtggtacagagggcagcgaagtcgtgaggccaagctaatcccttaaagccattctcagttcggattgtaggctgaaactcgcctacatgaagctggagttactagtaatcgcagatcagaatgctgcggtgaatgcgttcccgggtcttgtacaccccgcccgtcacaccatgggagttgggggcgcccgaagccggctagctaaccttttaggaagcggtc

SEQ ID NO: 557 - DNA, 1505 bp, Clostridium beijerinckii
agagtttgatcctggctcaggacgaacgctggcggcgtgcttaacacatgcaagtcgagcgatgaagttccttcgggaacggattagcggcggacgggtgagtaacacgtgggtaacctgcctcatagaggggaatagcctttcgaaaggaagattaataccgcataagattgtagtgccacatggcatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactcttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgcgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcggggcagcgacctaaggtagggtcagcgattggggtgaagtcgtaacaaggtagccgtaggagaacctgcggctggatcacctccttt

SEQ ID NO: 558 - DNA, 1329 bp, Clostridium bifermentans
  modified_base (1316)..(1316): a, c, t, g, unknown or other
  modified_base (1320)..(1321): a, c, t, g, unknown or other
gatctcttcggagagagcggcggacgggtgagtaacgcgtgggtaacctgccctgtacacacggataacataccgaaaggtatactaatacgggataacatatgaaagtcgcatggcttttgtatcaaagctccggcggtacaggatggacccgcgtctgattagctagttggtaaggtaatggcttaccaaggcaacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggtaactactgccccggatacagggggtcggaattactgggcgtaaagggtgcgtaggtggttttttaagtcagaagtgaaaggctacggctcaaccgtagtaagcttttgaaactagagaacttgagtgcaggagaggagagtagaattcctagtgtagcggtgaaatgcgtagatattaggaggaataccagtagcgaaggcggctctctggactgtaactgacactgaggcacgaaagcgtggggagcaaacaggattagataccctggtagtccacgccgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcaaagctacgcgaagaaccttacctaagcttgacatccggctacgcctcacccgaagtgagcttttccatctggggaagtggtgacaggtggtgcatggttgtcgtcagctcgtgtcgtgagatgttgggttaagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaagccgcgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatggaagttgggggcgcccgaagccggttagctancctnntaggaagc

SEQ ID NO: 559 - DNA, 1377 bp, Clostridium bolteae
  modified_base (13)..(13): a, c, t, g, unknown or other
gaagcaattaaanggaagttttcggatggaatttgattgactgagtggcggacgggtgagtaacgcgtggataacctgcctcacactgggggataacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatccttttgaccggcgtgtaacggcgccttcccttcggggcaagagagacaggtggtgcatggccgtcgtcagctcgtgtcgtgagatgttgggttaagtcccgcaacgagcgcaacccttatccttagtagccagcaggtagagctgggcactctagggagactgccagggataacctggaggaaggtggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaag

SEQ ID NO: 560 - DNA, 1355 bp, Clostridium botulinum
tgaagcttccttcgggaagtggattagcggcggacgggtgagtaacacgtgggtaacctgcctcaaagtgggggatagccttccgaaaggaagattaataccgcataacataagagaatcgcatgattttcttatcaaagatttattgctttgagatggacccgcggcgcattagctagttggtaaggtaacggcttaccaaggcaacgatgcgtagccgacctgagagggtgatcggccacattggaactgagacacggtccagactcctacgggaggcagcagtggggaatattgcgcaatgggggaaaccctgacgcagcaacgccgcgtgggtgagaaggtcttcggattgtaacctgttttctgggacgataatgacggtaccagaggaggaagccacggctaactacgtgccagcagccgcggtaatacgtaggtggcgagcgttgtccggatttactgggcgtaaagggtgcgtaggcggatgtttaagtgggatgtgaaatccccgggcttaacctgggggctgcattccaaactggatatctagagtgcaggagaggaaagcggaattcctagtgtagcggtgaaatgcgtagagattaggaagaacaccagtggcgaaggcggctttctggactgtaactgacgctgaggcacgaaagcgtgggtagcaaacaggattagataccctggtagtccacgccgtaaacgatggatactaggtgtagggggtatcaactccccctgtgccgcagttaacacaataagtatcccgcctggggagtacggtcgcaagagtaaaactcaaaggaattgacgggggcccgcacaagcagcggagcatgtggtttaattcgaagcaacgcgaaaaaccttacctggacttgacatcccttgcatagcctagagataggtgaagcccttcggggcaaggagacaggaggtgcatgggtgtcgtcagctcgtgtcgtgagatgttaggttaagtcctgcaacgagcgcaacccttgttattagttgctaccattaagttgagcactctaatgagactgcctgggtaaccaggaggaaggtggggatgacgtcaaatcatcatgccccttatgtccagggctacacacgtgctacaatggtaggtacaataagacgcaagaccgtgaggtggagcaaaacttataaaacctatctcagttcggattgtaggctgcaactcgcctacatgaagctggagttgctagtaatcgcgaatcagaatgtcgcggtgaatacgttcccgggccttgtacacaccgcccgtcacaccatgagagctggtaacacccgaagtccgtgaggtaaccgtaaggagc

SEQ ID NO: 561 - DNA, 1366 bp, Clostridium butyricum
tcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggacatgtggtttaattgaagcaacgcgaagaaccttacctagacttgacatctcctgaattctctgtaatggagaagccacttcggtggcaggaagacaggtggtgcatggttgtggtcagctcgtgtcgtgagatgttgggttaagtcccgcaacgagcgcaacccttattgttagttgctcccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtagggtgaaactcgcctacatgaagctggagttgctagtaatcgcgaatcagaatgtcgcggagaatacgttcccgggccttgtacacaccgcccgtcacaccatgagagttggcaatacccaaagttcgtgagctaaccgcaaggaggca

SEQ ID NO: 562 - DNA, 1473 bp, Clostridium cadaveris
agagtttgatcctggctcaggatgaacgctggcggcgtgcttaacacatgcaagtcgagcgagggagcaccttcgggtgtgaactagcggcggacgggtgagtaacacgtgggcaacctgccttacagagggggatagccttccgaaaggaagattaataccgcatattatgatttttctgcatgggaaagtcatgaaaggagcaatccgctgtaagatgggcccgcggcgcattagctagttggtgaggtaagggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaagctctgtcttcagggacgataatgacggtacctgaggaggaagccacggctaactacgtgccagcagccgcggtaatacgtaggtggcgagcgttatccggatttactgggcgtaaaggatgcgtaggtggaattttaagtgggatgtgaaatacccgggctcaacctgggaactgcattccaaactggaattctagagtgcaggagaggaaagcggaattcctagtgtagcggtgaaatgcgtagagattaggaagaacaccagtggcgaaggcggctttctggactgtaactgacactgaggcatgaaagcgtggggagcaaacaggattagataccctggtagtccacgccgtaaacgatgggtactaggtgtaggggtttcgatacctctgtgccgccgtaaacacaataagtaccccgcctggggagtacggtcgcaagattaaaactcaaaggaattgacgggggcccgcacaagtagcggagcatgtggtttaattcgaagcaacgcgaagaaccttacctagacttgacatgtcctgaattacctgtaataagggaagctctttcgggagcaggaacacaggtggtgcatggttgtcgtcagctcgtgtcgtgagatgttgggttaagtcccgcaacgagcgcaacccctatagttagttgctaacagtaagatgagcactctagctagactgccgtggttaacgcggaggaaggtggggatgacgtcaaatcatcatgccccttatgtctagggctacacacgtgctacaatggcgagaacaaagagaagcaagaccgcgaggtggagcaaaactcataaaactcgtcccagttcggattgcaggctgcaactcgcctgcatgaagccggagttactagtaatcgcgaatcagaatgtcgcggtgaatacgttcccgggccttgtacacaccgcccgtcacaccatgagagttggcaatacccaaagtccgtgaggtaaccgaaaggagccagcggcctaaggtagggtcagcgattggggtgaagtcgtaacaaggtaacc

SEQ ID NO: 563 - DNA, 1499 bp, Clostridium carboxidivorans
ttgatcctggctcaggacgaacgctggcggcgtgcttaacacatgcaagtcgagcgatgaaatcccttcggggatggattagcggcggacgggtgagtaacacgtgggcaacctgcctcaaagtgggggatagccttccgaaagggagattaataccgcataacattagtttttcacatgaaatactaattaaaggagtaatccgctttgagatgggcccgcggcgcattagctagttggtgaggtaacggctcaccaaggccacgatgcgtagccgacctgagagggtgatcggccacattggaactgagacacggtccagactcctacgggaggcagcagtggggaatattgcacaatgggcgaaagcctgatgcagcaacgccgcgtgagtgatgaaggccttcgggttgtaaagctctgtctttggggacgataatgacggtacccaaggaggaagccacggctaactacgtgccagcagccgcggtaatacgtaggtggcgagcgttgtccggatttactgggcgtaaaggatgcgtaggcggatgtttaagtcagatgtgaaaatcccgagcttaacttgggaactgcatttgaaactggatatctagagtgcgggagaggagaatggaattcctagtgtagcggtgaaatgcgtagagattaggaagaacaccagtggcgaaggcgattctctggaccgtaactgacgctgaggcatgaaagcgtgggtagcaaacaggattagataccctggtagtccacgccgtaaacgatgaatactaggtgtaggaggtatcgactccttctgtgccgcagctaacgcaataagtattccgcctgggaagtacgatcgcaagattaaaactcaaaggaattgacgggggcccgcacaagcagcggagcatgtggtttaattcgaagcaacgcgaagaaccttacctagacttgacatcccctgaattacctgtaatgagggaagcccttcggggcagggagacaggtggtgcatggttgtcgtcagctcgtgtcgtgagatgttaggttaagtcctgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggtgagtacagaaagatgcaagaccgtgaggtggagcaaaacttttaaaactcatctcagttcggattgtaggctgaaactcgcctacatgaagctggagttgctagtaatcgcgaatcagcatgtcgcggtgaatacgttcccgggccttgtacacaccgcccgtcacaccatgagagctggcaacacccgaagtccgtgaggtaaccgtaaggagccagcggccgaaggtggggttagtaattggggtgaagtcgtaacaaggtagccgtaggagaacctgcggctggatcacctcctt

SEQ ID NO: 564 - DNA, 1458 bp, Clostridium carnis
  modified_base (1)..(3): a, c, t, g, unknown or other
  modified_base (92)..(92): a, c, t, g, unknown or other
  modified_base (96)..(97): a, c, t, g, unknown or other
  modified_base (606)..(607): a, c, t, g, unknown or other
  modified_base (837)..(837): a, c, t, g, unknown or other
  modified_base (930)..(944): a, c, t, g, unknown or other
  modified_base (1172)..(1172): a, c, t, g, unknown or other
  modified_base (1360)..(1360): a, c, t, g, unknown or other
nnntaggtgagagtttgatcctggctcaggacgaacgctggcggcgtgcctaacacatgcaagtcgagcgaggggagtttcttcggaaaccnaacnnagcggcggacgggtgagtaacacgtgggcaacctgccttgtagaggggaatagccttccgaaaggaagattaataccgcataatattgcagcttcgcatgaagcagtaattaaaggagcaatccgctacaagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtcttcggggacgataatgacggtacccgaggaggaagccacggctaactacgtgccagcagccgcggtaatacgtaggtggcaagcgttgtccggatttactgggcgtaaagggagcgtaggcggacttttaagtgagatgtgaaatacccgggctcaacctgggnnctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggttgtcatgacctctgtgccgcngctaacgcattaagtattccgcctggggagtacggtcgcaagattaaaactcaaaggaattgacgggggcccgcacaagcagcggagcatgtnnnnnnnnnnnnnnnaacgcgaagaaccttacctagacttgacatctcctgcattactcttaatcgaggaagtcctttcggggacaggatgacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcnaatcatcatgccccttatgtctagggctacacacgtgctacaatggcaagtacaaagagatgcaataccgcgaggtggagctaaactataaaacttgtctcagttcggattgtaggctgaaactcgcctacatgaagctggagttgctagtaatcgcgaatcagcatgtcgcggtgaatacgttcccnggccttgtacacaccgcccgtcacaccatgagagttggcaatacccaaagttcgtgagctaaccgcaaggaggcagcgacctaaggtagggtcagcga

SEQ ID NO: 565 - DNA, 1012 bp, Clostridium celatum
  modified_base (14)..(14): a, c, t, g, unknown or other
  modified_base (40)..(42): a, c, t, g, unknown or other
  modified_base (63)..(63): a, c, t, g, unknown or other
  modified_base (107)..(107): a, c, t, g, unknown or other
  modified_base (109)..(109): a, c, t, g, unknown or other
  modified_base (111)..(111): a, c, t, g, unknown or other
gggtgtaaagctcngtcttcagggacgataatgacggtannngaggaggaagccacggctaantacgtgccagcagccgcggtaatacgtaggtggcgagcgttgtncngnatttactgggcgtaaagggagcgtaggcggacttttaagtgagatgtgaaatacccgggctcaacttgggtgctgcatttcaaactggaagtctagagtgcaggagaggagaatggaattcctagtgtagcggtgaaatgcgtagagattaggaagaacaccagtggcgaaggcgattctctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccgtaactggggaagtcgcttcggcgacaggaagacaggtggtgcatggttgtcgtcagctcgtgtcgtgagatgttgggttaagtcccgcaacgagcgcaacccctattgttagttgctaccattaagttgagcactctagcgagactgcccgggttaaccgggaggaaggtggggatgacgtcaaatcatcatgccccttatgtctagggctacacacgtgctacaatggcaagtacaaagagaagcaagaccgcgaggtggagcaaaactcaaaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagtgcgtgatctgactcgcaagagagga

SEQ ID NO: 566 - DNA, 1435 bp, Clostridium celerecrescens
catgcaagtcgagcgaagcgatttcaaggaagttttcggacggaattgaaattgactgagcggcggacgggtgagtaacgcgtgggtaacctgcctcatacagggggataacagttggaaacgactgctaataccgcataagcacacagtgccgcatggtacggtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcactgcaagtctggagtgaaagcccggggctcaaccccgggactgctttggaaactgtggtgctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaatttgacggggacccgcacaagcggtggagcatgtggtttaattcgaagcaacgcgaagaaccttaccaagtcttgacatcggaatgaccgggatgtaacgatcccttccctacggggcattccagacaggtggtgcatggttgtcgtcagctcgtgtcgtgagatgttgggttaagtcccgcaacgagcgcaacccttatccttagtagccagcaagttaagttgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgtaaggagggagctgccgaaggcgggactgataactggggtgaagtcg

SEQ ID NO: 567 - DNA, 1500 bp, Clostridium cellulosi
  modified_base (1380)..(1381): a, c, t, g, unknown or other
tttgatcctggctcaggacgaacgctggcggcgtgcctaacacatgcaagtcgagcggagatagtacttcggttctatcttagcggcggacgggtgagtaacgcgtgagcaacctgccctgagcacggggatagcgtctggaaacggacggtaataccgcataatgtacgttggaggcatctccgatgtaccaaaggaggaatccactcaaggatgggctcgcgtccgattaggtagttggtgaggtaacggcccaccaagcctgcgatcggtagccggactgagaggttgtacggccacattgggactgagacacggcccagactcctacgggaggcagcagtggggaatattgcacaatggaggaaactctgatgcagcgacgccgcgtgagggaagaaggtcttcggattgtaaacctctgtctttcgggacgaaggaagtgacggtaccgaaagaggaagccacggctaactacgtgccagcagccgcggtaatacgtaggtggcgagcgttgtccggaattactgggtgtaaagggtgcgtaggcgggttgtcaagttggatgtgaaatctctgggcttaactcagaggttgcattcaaaactggcgatcttgagtgaggtagaggcaggcggaattcccggtgtagcggtgaaatgcgtagatatcgggaggaacaccagtggcgaaggcggcctgctgggccttaactgacgctgaggcgcgaaagcgtggggagcaaacaggattagataccctggtagtccatgctgtaaacgatgattgctaggtgtgggtggactgaccccatccgtgccggagttaacacaataagcatcccacctggggagtacggccgcaaggctgaaactcaaaggaattgacgggggcccgcacaagcagtggagtatgtggtttaattcgaagcaacgcgaagaaccttaccaggtcttgacatccaccgaatccggaagagattctggagtgcccttcggggagcggtgagacaggtggtgcatggttgtcgtcagctcgtgtcgtgagatgttgggttaagtcccgcaacgagcgcaacccttgttaatagttgctacgcaagagcactctattaagactgccgttgataaaacggaggaaggtggggatgacgtcaaatcatcatgccccttatgacctgggctacacacgtactacaatggccgccaacaaagggaagcaataccgcgaggtggagcgaatccccaaaagcggtcccagttcagattgcaggctgcaacccgcctgcatgaagacggaattgctagtaatcgcggatcagcatgccgcggtgaatacgttcccgggccttgtacacaccgcccgtcacaccatgagagnnggcaacacccgaagtcgtttgcgtaaccgaaaggagcgcggcgccgaaggtgggatcggtgattggggtgaagtcgtaacaaggtagccgtatcggaaggtgcggctggatcacctcct

SEQ ID NO: 568 - DNA, 1283 bp, Clostridium chauvoei
tgggcaacctgccttgtagaggggaatagccttccgaaaggaagattaataccgcataatattgcagcttcgcatggagcagtaattaaaggagcaatccgctacaagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtcttcagggacgataatgacggtacctgaggaggaagccacggctaactacgtgccagcagccgcggtaatacgtaggtggcgagcgttgtccggattttttgggcgtaaagggagcgtaggcggacttgtaagtgagatgtgaaatacccgggctcaacttgggtgctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatggatactaggtgtgggaggtatcaactccttccgtgccgccgttaacacattaagtatcccgcctggggagtacggtcgcaagattaaaactcaaaggaattgacgctagcccgcacaagcagcggagcatgtggtttaattcgaagcaacgcgaagaaccttacctagacttgacatctcctgcattactcttaatcgaggaagtctcttcggagacaggatgacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggtagtgacgtcaaatcatcatgccccttatgtctagggctacacacgtgctagaatggcaagtacaacgagatgcaataccgcgaggtggagctaaactataaaacttgtctcagttcggattgtaggctgaaactcgcctacatgaagctggagttgctagtaatcgcgaatcagcatgtcgcggtgaatacgttcccgagccttgtacacaccgcccgtcacaccatgagagttggcaata

SEQ ID NO: 569 - DNA, 1383 bp, Clostridium citroniae
  modified_base (12)..(14): a, c, t, g, unknown or other
acgaagcaattnnnaatgaagttttcggatggatttctgattgactgagtggcggacgggtgagtaacgcgtggataacctgcctcacactgggggataacagttagaaatggctgctaataccgcataagcgcacagtaccgcatggtacggtgtgaaaaactccggtggtgtgagatggatccgcgtctgattagttagttggcggggtaacggcccaccaagacagcgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctggagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcaataagcattccacctggggagtacgttcgcaagaatgaaactcaaaggaattgacggggacccgcacaagcggtggagcatgtggtttaattcgaagcaacgcgaagaaccttaccaagtcttgacatccccctgaccggtcggtaaagcggcctttccttcgggacaggggagacaggtggtgcatggttgtcgtcagctcgtgtcgtgagatgttgggttaagtcccgcaacgagcgcaacccttatccttagtagccagcaggtaaagctgggcactctagggagactgccagggataacctggaggaaggtggggatgacgtcaaatcatcatgccccttatgatttgggctacacacgtgctacaatggcgtaaacaaagggaagcgaccctgcgaaggcaagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggag

SEQ ID NO: 570 - DNA, 1560 bp, Clostridium clariflavum
gacgaacgctggcggcgtgcctaacacatgcaagtcgagcggtcctgcattcaacattgagtattcagctgacgttggagattgagccggcgtcaagcagaaacaaccatatactatgatatgtttaaagtttctgcttcacgctgaataaagtgccaacacaaaaaggagctgagtattgaatgttgaatgcaggatagcggcggacgggtgagtaacgcgtgggtaatctgcctcacacagggggataacactgggaaactagtgctaataccgcataacataacgaggtggcatcactttgttatcaaaggagcaatccggtgtgagatgagcccgcgtccgattagctagttggtgaggtaacggctcaccaaggcgacgatcggtagccgaactgagaggttgatcggccacattgggactgagacacggcccagactcctacgggaggcagcagtggggaatattgcgcaatgggggaaaccctgacgcagcaacgccgcgtgaaggaagaaggtcttcggattgtaaacttctttggttggggacgataatgacggtacccaaggaacaagccacggctaactacgtgccagcagccgcggtaatacgtaggtggcgagcgttgtccggaattactggatgtaaagggcgcgtaggcggggatgcaagtcagatgtgaaattccggggctcaaccccggcgctgcatctgaaactgtatttcttgagtgttggagaggaaagcggaattcctagtgtagcggtgaaatgcgtagagattaggaggaacaccagtggcgaaggcggctttctggacagtaactgacgctgaggcgcgaaagcgtggggagcaaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacatccctctgacagctctagagatagggcttctcttcggagcagaggagacaggtggtgcatggttgtcgtcagctcgtgtcgtgagatgttgggttaagtcccgcaacgagcgcaacccttgttgttagttgccatcattaagttgggcactctaacgagactgccggtgataaatcggaggaaggtggggacgacgtcaaatcatcatgccccttatgtcctgggctacacacgtactacaatggctgctacaaagggaagcgagaccgcgaggtggagcaaatccccaaaagcagtcccagttcagattgcaggctgaaactcgcctgcatgaagtcggaattgctagtaatggcaggtcagcatactgccgtgaatacgttcccgggccttgtacacaccgcccgtcacaccatgagagtctgcaacacccgaagtcagtagtctaaccgagaggagggcgctgccgaaggtggggcagatga

SEQ ID NO: 571 - DNA, 1475 bp, Clostridium clostridiiformes
  modified_base (534)..(534): a, c, t, g, unknown or other
  modified_base (917)..(917): a, c, t, g, unknown or other
  modified_base (954)..(954): a, c, t, g, unknown or other
  modified_base (1010)..(1010): a, c, t, g, unknown or other
  modified_base (1453)..(1453): a, c, t, g, unknown or other
  modified_base (1471)..(1471): a, c, t, g, unknown or other
aacatgagagtttgatcctggctcaggatcaacgctggcggcgtgcctaacacatgcaagtcgaacgaagcaattaagatgaagttttcggatggaatcttgattgactgagtggcggacgggtgagtaacgcgtggataacctgcctcacactgggggataacagttagaaatgactgctaataccgcataagcgcacagtgccgcatggcagtgtgtgaaaaactccggtagtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcnagcgttatccggatttactgggtgtaaagggagcgtagacggcgaagcaagtctgaagtgaaaacccagggctcaaccctggcactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagccttcggtgccgccgcaaacgcagtaagcattccacctggggagtacgttcgcaagaatgaaactcaaaggaattgacgggganccgcacaagcggtggagcatgtggtttaattcgaagnaacgcgaagaaccttaccaagtcttgacatccccctgacggccggtaacgcggccnttcttcgggacaggggagacaggtggtgcatggttgtcgtcagctcgtgtcgtgagatgttgggttaagtcccgcaacgagcgcaacccttatccttagtagccagcaggtaaagctgggcactctagggagactgccagggataacctggaggaaggtggggatgacgtcaaatcatcatgccccttatgatttgggctacacacgtgctacaatggcgtaaacaaagggaagcgagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccnaaggcggggcaggtaacngggg

SEQ ID NO: 572 - DNA, 1370 bp, Clostridium clostridioforme
attaagatgaagttttcggatggaatcttgattgactgagtggcggacgggtgagtaacgcgtggataacctgcctcacactgggggataacagttagaaatgactgctaataccgcataagcgcacagtgccgcatggcagtgtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaagacggtacctgctaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgccgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatccccctgacgggccggtaacgcgggcgtttcattgggtagaggtagacaggtggagcatgggcgtcgtcagctcgtgtcgtgagatgttgggttaagtcccgcaacgagcgcaacccttatccttagtagccagcacgtgaaggtgggcactctagggagactgccagggataacctggaggaaggtggggatgacgtcaaatcatcatgccccttatgatttgggctacacacgtgctacaatggcgtaaacaaagggaagcgagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaagg

SEQ ID NO: 573 - DNA, 1521 bp, Clostridium coccoides
tttgagtttgatcctggctcaggatgaacgctggcggcgtgcttaacacatgcaagtcgagcgaagcgctaagacagatttcttcggattgaagtctttgtgactgagcggcggacgggtgagtaacgcgtgggtaacctgcctcatacagggggataacagttagaaatgactgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgttgttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccgtcccgtaacgggggcttcccttcggggcagaggagacaggtggtgcatggttgtcgtcagctcgtgtcgtgagatgttgggttaagtcccgcaacgagcgcaacccttatccttagtagccagcacatgatggtgggcactctagggagactgccggggataacccggaggaaggcggggacgacgtcaaatcatcatgccccttatgatttgggctacacacgtgctacaatggcgtaaacaaagggaagcgagacagcgatgttgagcgaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgaaaggaaggagctgccgaaggcgggaccgataactggggtgaagtcgtaacaaggtagccgtatcggaaggtgcggctggatcccc

SEQ ID NO: 574 - DNA, 1462 bp, Clostridium cochlearium
  modified_base (1)..(2): a, c, t, g, unknown or other
  modified_base (289)..(289): a, c, t, g, unknown or other
  modified_base (523)..(523): a, c, t, g, unknown or other
  modified_base (930)..(943): a, c, t, g, unknown or other
  modified_base (967)..(967): a, c, t, g, unknown or other
  modified_base (1136)..(1136): a, c, t, g, unknown or other
  modified_base (1213)..(1213): a, c, t, g, unknown or other
  modified_base (1363)..(1363): a, c, t, g, unknown or other
  modified_base (1383)..(1383): a, c, t, g, unknown or other
  modified_base (1458)..(1458): a, c, t, g, unknown or other
nnttaaattgagagtttgatcctggctcaggacgaacgctggcggcgtgcttaacacatgcaagtcgagcgatgaagcttccttcgggaagtggattagcggcggacgggtgagtaacacgtgggcaacctgcctcaaagaggggaatagccctccgaaaggaggattaataccgcataaagttagagtttcgcatgaaactttaaccaaaggagtaatctgctttgagatgggcccgcgtcccattagctagttggtaaggtaatggcttaccaaggcaacgatgggnagccgacctgagagggtgatcggccacattggaactgagacacggtccagactcctacgggaggcagcagtggggaatattgcgcaatgggggaaaccctgacgcagcaacgccgcgtgggtgatgaaggttttcggatcgtaaaaccctgttttctgggacgataatgacggtaccagatgaggaagccacggctaactacgtgccagcagccgcggtaatacgtaggtggcnagcgttgtccggatttactgggcgtaaagggtgcgtaggcggatgcttaagtgagatgtgaaatacctaggcttaacttaggggctgcatttcaaactgggcatctagagtacaggagagggaaacggaattcctagtgtagcggtgaaatgcgtagagattaggaagaacaccagtggcgaaggcggtttcctggactgtaactgacgctgaggcacgaaagcgtgggtagcaaacaggattagataccctggtagtccacgccgtaaacgatgaatactaggtgtaggagggtccaaccttctgtgccgcagttaacacattaagtattccgcctggggagtacggtcgcaagactaaaactcaaaggaattgacgggggcccgcacaagcagcggagcatgtgnnnnnnnnnnnnnnaacgcgaagaaccttacctggacntgacatcccctgaattactcgtaactgaggaaatctcttcggagacagggagacaggtggtgcatggttgtcgtcagctcgtgtcgtgagatgttgggttaagtcccgcaacgagcgcaacccttattattagttgctaccattaagttgagcactctaatgagactgnccgggtgaaccgggaggaaggtggggatgacgtcaaatcatcatgccccttatgtccagggctacacacgtgctacnatggtgggtacagagagaagcgataccgcgaggtggagcaaatctcaaaaacccatcccagttcggattgcaggctgaaactcgcctgcatgaagccggagttgctagtaatcgcaaatcagaatgttgcggtgaatacgttcccgggcnttgtacacaccgcccgtcanaccatgagagttggcaacacccgaagtccgtgaggtaaccgtaaggagccagcggccgaaggtggggttaatgantggg

SEQ ID NO: 575 - DNA, 1489 bp, Clostridium cocleatum
ctcaggatgaacgctggcggcgtgcctaatacatgcaagtcgaacgcgggcacttgtgcccgagtggcgaacgggtgagtaatacataagtaacctggcctttacagggggataactgctggaaacggtagctaagaccgcataggtagggacactgcatggtgaccgtattaaaagtgctgcaaggcactggtagaggatggacttatggcgcattagctggttggtgaggtaacggctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaagaaggaattcgttctgtaaacttctgttataaaggaagaaaggcggatggaggaaatgacatccgagtgacggtactttatgagaaagccacggctaactacgtgccagcagccgcggtaatacgtaggtggcaagcgttatccggaattattgggcgtaaagagggagcaggcggcagcaaaggtctgtggtgaaagactgaagcttaacttcagtaagccatagaaaccaggcagctagagtgcaggagaggatcgtggaattccatgtgtagcggtgaaatgcgtagatatatggaggaacaccagtggcgaaggcgacgatctggcctgtaactgacgctcagtcccgaaagcgtggggagcaaataggattagataccctagtagtccacgccgtaaacgatgagtactaagtgttggaagtcaaatttcagtgctgcagttaacgcagtaagtactccgcctgagtagtagcttcgcaagaatgaaactcaaaggaattgacgggggcccgcacaagcggtggagcatgtggtttaattcgaagcaacgcgaagaaccttaccaggtcttgacatactcataaaggatccagagatggatagatagttatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggcgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccatgagagttgataacacccgaagccggtggcctaaccgaaaggaaggagctgtctaaggtgggattgatgattggggtgaagtcgtaacaaggtatccctacgggaacgtgggg

SEQ ID NO: 576 - DNA, 1451 bp, Clostridium colicanis
  modified_base (729)..(729): a, c, t, g, unknown or other
  modified_base (873)..(873): a, c, t, g, unknown or other
agtcgagcgatgaaattttcttcggaaatggattagcggcggacgggtgagtaacacgtgggtaacctgccctatagagagggatagccttccgaaagggagattaatacctcataatatcctagtatcgcatgatacatggattaaaggagcaatccgctataggatggacccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggcggatctttaagtgggatgtgaaatactcgggctcaacctgggggctgcattccaaactggggatctagagtacaggaggggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtanacgatgaatactaggtgtagggggtgtcaactccccctgtgccgccgctaacgcattaagtattccgcctggggagtacggtcgcaagattaaaactcaaaggaattgacgggggcccgcacaagtagcggagcatgtggtttnattcgacgcacgcgaagaacttacctagacttgacatcttctgcattacccttaatcggggaagttccttcggggacagaatgacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggccggtacagaaagacgcgataccgcgaggtggagcaaaactttaaaaccggtctcagttcggattgtaggctgaaactcgcctacatgaagctggagttactagtaatcgcgaatcagcatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcct

SEQ ID NO: 577 - DNA, 1473 bp, Clostridium colinum
cggcgtgcctaacacatgcaagtcgagcggagttttatgggagcttgcttttataaaacttagcggcggacgggtgagtaacgcgtgggtaacctgccctatacacagggataacattgagaaattgatgctaatacctgataagccaacagtaggcatctacaagttggaaaaactgaggtggtataggaggggcccgcgtctgattagctagttggtggggtaaaggcctaccaaggcgacgatcagtagccgacctgagagggtgatcggccacattggaactgagacacggtccaaactcctacgggaggcagcagtggggaatattgcacaatggggggaaccctgatgcagcaacgccgcgtgaaggaagaagtatttcggtatgtaaacttctatcgacagggaagaaataaatgacggtacctgaataagaagcaccggctaaatacgtgccagcagccgcggtaatacgtatggtgcaagcgttatccggatttactgggtgtaaagggtgagtaggcggttatgcaagtcatatgtgaaattctggggctcaacctcagggctgcataagaaactgtgtaactagagtacaggagaggtaagcggaattcctagtgtagcggtgaaatgcgtagatattaggaagaacaccggtggcgaaggcggcttactggactgaaactgacgctgagtcacgaaagcgtggggagcgaacaggattagataccctggtagtccacgccgtaaacgatgagtgctaggtgttgggaagagattctcggtgccgcagcaaacgcaataagcactccacctggggagtacgaccgcaaggttgaaactcaaaggaattgacggggaccgcacaagcggtggagcatgtggtttaattcgaagcaacgcgaagaaccttacctaaacttgacatcccgatgacaatctgtgtaatgcagactttcttcggaacatcggtgacaggtggtgcatggttgtcgtcagctcgtgtcgtgagatgttgggttaagtcccgcaacgagcgcaacccctattcttagtagccagcawttcggatgggcactctagggagactgccgtggataacacggaggaaggtggggatgacgtcaaatcatcatgccccttatgtttagggctacacacgtgctacaatggctgtaacaaagtgaagcaagatagtgatatggagcaaagcacaaaaaagcagtcccagttcggattgtagtctgcaactcgactacatgaagttggaatcgctagtaatcgcgaatcagaatgtcgcggtgaatacgttcccgggtcttgtacacaccgcccgtcacaccatgggagttggaagcgcccgaagcctgtgacctaaccgcaaggaggagcagtcgaaggtgaagccagtgactggggtgaagtcgtaacaaggtagccgtatcggaaggtgcgctgatcacctcc

SEQ ID NO: 578 - DNA, 1365 bp, Clostridium difficile
  modified_base (1347)..(1347): a, c, t, g, unknown or other
  modified_base (1352)..(1353): a, c, t, g, unknown or other
ttgagcgatttacttcggtaaagagcggcggacgggtgagtaacgcgtgggtaacctaccctgtacacacggataacataccgaaaggtatgctaatacgggataatatatttgagaggcatctcttgaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccttcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggaaagttcccttcggggagattggggacagaggggaattgcttgtgtagcgctggtatggggagatattgggataagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgattatctanccttnngaagaagtcgtc

SEQ ID NO: 579 - DNA, 1379 bp, Clostridium disporicum
  modified_base (14)..(14): a, c, t, g, unknown or other
  modified_base (28)..(29): a, c, t, g, unknown or other
tcgagcgagtggangttcttcggaacannagctagcggcggacgggtgagtaacacgtgggcaacctgcctcatagaggggaatagcctcccgaaagggagattaataccgcataagattgtagcttcgcatgaagtagcaattaaaggagcaatccgctatgagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaatgccgcgtgagtgatgacggccttcgggttgtaaagctctgtcttcggggacgataatgacggtacccgaggaggaagccacggctaactacgtgccagcagccgcggtaatacgtaggtggcaagcgttgtccggatttactgggcgtaaagggagcgtaggcggatttttaagtgagatgtgaaatacccgggcttaacttgggtgctgcatttcaaactggaagtctagagtgcaggagaggagaagggaattcctagtgtagcggtgaaatgcgtagagattaggaagaacaccagtggcgaaggcgcttctctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccgtaactggggaagtcgcttcggcgacaggaagacagtaggtgcatggaagtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagaagcaagaccgcgaggtggagcaaaactcaaaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagtgcgtgatctaactcgcaagagaggaagcgccc

SEQ ID NO: 580 - DNA, 1473 bp, Clostridium estertheticum
cctggctcaggacgaacgctggcggcgtgcctaacacatgcaagtcgagcgatgcgatccttcggggtcaattagcggcggacgggtgagtaacacgtgggtaacctgcctcaaagaggggaatagcctcccgaaagggagattaataccgcataatatgttttgatcgcatgatcttaacatcaaaggaatttttcggaatttcactttgagatggacccgcggcgcattagctagttggtgaggtaaaggcccaccaaggcaacgatgcgtagccgacctgagagggtgatcggccacattggaactgagacacggtccagactcctacgggaggcagcagtggggaatattgcgcaatgggggaaaccctgacgcagcaacgccgcgtgaatgatgaaggccttcgggttgtaaagttctgtcttctgggacgataatgacggtaccagaggaggaagccacggctaactacgtgccagcagccgcggtaatacgtaggtggcaagcgttgtccggatttactgggcgtaaaggatgcgtaggcggacatttaagtcagatgtgaaatacccgagcttaacttgggtgctgcatttgaaactgggtgtctagagtgcaggagaggtaagtggaattcctagtgtagcggtgaaatgcgtagagattaggaagaacaccagtggcgaaggcgacttactggactgtaactgacgctgaggcatgaaagcgtggggagcaaacaggattagataccctggtagtccacgccgtaaacgatgaatactaggtgtcgggggtcgaacctcggtgccgccgttaacacattaagtattccgcctggggagtacgatcgcaagattaaaactcaaaggaattgacgggggcccgcacaagcagcggagcatgtggtttaattcgaagcaacgcgaagaaccttacctagacttgacatcccttgcataactcagagatgagtgaagtccttcgggacaaggtgacaggtggtgcatggttgtcgtcagctcgtgtcgtgagatgttgggttaagtcccgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggtgagtacaaagagatgcaagaccgcaaggtggagccaaactcaaaaactcatcccagttcggattgtaggctgcaactcgcctacatgaagccggagttgctagtaatcgcgaatcagcatgtcgcggtgaatacgttcccgggccttgtacacaccgcccgtcacaccatgagagttggtaacacccgaagtccgtgaggtaaccgtaaggagccagcggccgaaggtgggatcgatgattggggtgaagtcgtaacaaggtagccgtaggaga

SEQ ID NO: 581 - DNA, 1465 bp, Clostridium fallax
  modified_base (1)..(3): a, c, t, g, unknown or other
  modified_base (164)..(164): a, c, t, g, unknown or other
  modified_base (238)..(238): a, c, t, g, unknown or other
  modified_base (337)..(338): a, c, t, g, unknown or other
  modified_base (421)..(421): a, c, t, g, unknown or other
  modified_base (523)..(523): a, c, t, g, unknown or other
  modified_base (858)..(858): a, c, t, g, unknown or other
  modified_base (935)..(935): a, c, t, g, unknown or other
  modified_base (939)..(945): a, c, t, g, unknown or other
  modified_base (1151)..(1151): a, c, t, g, unknown or other
  modified_base (1171)..(1172): a, c, t, g, unknown or other
  modified_base (1360)..(1360): a, c, t, g, unknown or other
  modified_base (1461)..(1462): a, c, t, g, unknown or other
nnntaaattgagagtttgatcctggctcaggacgaacgctggcggcgtgcttaacacatgcaagtcgagcgagagagttttcttcggaaaactatctagcggcggacgggtgagtaacacgtgggtaacctgcctcatagagggggatagcctcccgaaagggngattaataccgcataacatcattttagcgcatgctcaaatgatcaaaggagtaatccgctatgagatggacccncggcgcattagctagttggtgaggtaacggctcaccaaggccacgatgcgtagccgacctgagagggtgatcggccacattgggactgagacacggccnngactcctacgggaggcagcagtggggaatattgcacaatgggggaaaccctgatgcagcaacgccgcgtgagtgatgacggcnttcgggttgtaaagctctgtctttagggacgataatgacggtacctaaggaggaagccacggctaactacgtgccagcagccgcggtaatacgtaggtggcnagcgttgtccggatttactgggcgtaaagggagcgtaggtggattcttaagtgagatgtgaaatacccgggcttaacttgggtcctgcatttcaaactgggaatctagagtgcaggagaggaaagtggaattcctagtgtagcggtgaaatgcgtagagattaggaagaacaccagtggcgaaggcgactttctggactgtaactgacactgaggctcgaaagcgtggggagcaaacaggattagataccctggtagtccacgccgtaaacgatggatactaggtgtgggaggtatcaactccttccgtgccgccgttaacacattaagtatccngcctggggagtacggtcgcaagattaaaactcaaaggaattgacggggacccgcacaagcagcggagcatgtggttnaatnnnnnnnaacgcgaagaaccttacctagacttgacatctcctgaattactcttaatcgaggaagcccttcggggacaggaagacaggtggtgcatggttgtcgtcagctcgtgtcgtgagatgttgggttaagtcccgcaacgagcgcaacccttattgttagttgctaccatttagttgagcactctagcgagactgcccgggttaaccggnaggaaggtggggatgacgtnnaatcatcatgccccttatgtctagggctacacacgtgctacaatggctggtacaaagagaagcaagaccgtgaggtggagcaaaactcaaaaaccagtcccagttcggattgtaggctgaaactcgcctacatgaagccggagttgctagtaatcgcgaatcagcatgtcgcggtgaatacgttcccnggtcttgtacacaccgcccgtcacaccatgagagttggcaatacccgaagtctgtgagctaacctgtaaagggggcaacggccgaaggtagggtcagcgannggg

SEQ ID NO: 582 - DNA, 1011 bp, Clostridium favososporum
  modified_base (8)..(8): a, c, t, g, unknown or other
  modified_base (855)..(855): a, c, t, g, unknown or other
  modified_base (929)..(929): a, c, t, g, unknown or other
  modified_base (943)..(943): a, c, t, g, unknown or other
  modified_base (945)..(947): a, c, t, g, unknown or other
  modified_base (949)..(949): a, c, t, g, unknown or other
  modified_base (991)..(991): a, c, t, g, unknown or other
gcgatgantttccttcgggaaacggattagcggcggacgggtgagtaacacgtgggtaacctgccttatagtgggggatagcctttcgaaaggaagattaataccgcataagattgtagtatcgcatgatatagcaattaaaggagcaatccgctataagatggacccgcgtcgcattagctagttggtgaggtaatggctcaccaaggcgacgatgcgtagccgacctgagagggtgatcggccacattgggactgagacacggcccagactcctacgggaggcagcagtggggaatattgcacaatgggcgaaagcctgatgcagcaacgccgcgtgagtgatgacggccttcgggttgtaaaactctgtcttcagggacgataatgacggtacctgaggaggaagccacggctaactacgtgccagcagccgcggtaatacgtaggtggcaagcgttgtccggatttactgggcgtaaagggagcgtaggcggatgtttaagtgggatgtgaaatactcgggctcaacttgagtgctgcattccaaactggatatctagagtgcaggagaggaaaggagaattcctagtgtagcggtgaaatgcgtagagattaggaagaataccagtggcgaaggcgcctttctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggancatgtggtttaattcgaagcaacgcgaagaaccttacctagacttgacatctcctgaattactctgtaatggangaagctcttcggancnnnanacaggtggtgcatggttgtcgtcagctcgtgtcgtgagatgntgggttaagtcccgcaacga

SEQ ID NO: 583 - DNA, 1439 bp, Clostridium felsineum
aacgctggcggcgtgcttaacacatgcaagtcgagcggggaacttcggttcccagcggcggacgggtgagtaacacgtgggtaacctgcctcatagtggggaatagccttccgaaaggaagattaataccgcataatactcggaaatcacatgatttctgagccaaaggatttattcgctatgagatggacccgcggcgcattagcttgttggtgaggtaacggctcaccaaggcttcgatgcgtagccgacctgagagggtgatcggccacattggaactgagacacggtccagactcctacgggaggcagcagtggggaatattgcacaatgggggaaaccctgatgcagcaacgccgcgtgagtgatgaaggtcttcggatcgtaaaactctgtcttatgggacgatgatgacggtaccataggaggaagccacggctaactacgtgccagcagccgcggtaatacgtaggtggcaagcgttgtccggatttactgggcgtaaaggatgtgtaggcggatatttaagtgagatgtgaaatccccgggcttaacttgggggctgcatttcaaactggatgtctggagtgcaggagaggaaggcagaattcctagtgtagcggtgaaatgcgtagagattaggaagaataccagtggcgaaggcggccttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctgggaagtacggtcgcaagattaaaactcaaaggaattgacggggacccgcacaagcagcggagcatgtggtttaattcgaagcaacgcgaagaaccttacctagacttgacatctcctgaattagtccgtaatggatgaagtcccttcggggacaggatgacaggtggtgcatggttgtcgtcagctcgtgtcgtgagatgttgggttaagtcccgcaacgagcgcaacccttatcattagttgctaacatttagttgagcactctagtgagactgcccgggttaaccgggaggaaggtggggatgacgtcaaatcatcatgccccttatgtctagggctacacacgtgctacaatggtagggacaaaaagatgctataccgcaaggtggagctaaactcaaaaccctatcccagttcggattgtaggctgaaactcgcctacatgaagccggagttgctagtaatcgcgaatcagaatgtcgcggtgaatacgttcccgggtcttgtacacaccgcccgtcacaccatgagagtcggcaacacccgaagcccgtgaggtaaccttttggaaccagcggtcgaaggtggggttgatgattggggtgaagtcgtaacaaggt

SEQ ID NO: 584 - DNA, 1481 bp, Clostridium frigidicarnis
agagtttgatcctggctcaggatgaatgctggcggcgtgcttaacacatgcaagtcgagcgagagagtctcttcggagacaatagcggcggacgggtgagtaacacgtgggcaacctgccttgtagtgggggatagccctccgaaaggaggattaataccgcatattgtcacattgaggcatctcaaagtgatgaaaggagtaatccgctacaagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggtcttcggattgtaaagctctgtcttcggggacgataatgacggtacccgaggaggaagccacggctaactacgtgccagcagccgcggtaatacgtaggtggcaagcattatccggatttactgggcgtaaagggtgcgtaggcggatttttaagtgagatgtgaaatacccgggctcaacctgggggctgcatttcaaactggaaatctagagtgcaggagaggaaagtggaattcctagtgtagcggtgaaatgcgtagagattaggaagaacaccagtggcgaaggcgactttctggactgtaactgacgctgaggcacgaaagcgtggggagcaaacaggattagataccctggtagtccacgccgtaaacgatggatactaggtgtgggaggtttaactccttccgtgccgccgttaacacattaagtatcccgcctggggagtacggtcgcaagattaaaactcaaaggaattgacgggggcccgcacaagtagcggagcatgtggtttaattcgaagcaacgcgaagaaccttacctagacttgacatgtcctgaattaccagtaatgtgggaagtccttcggggacaggaacacaggtggtgcatggttgtcgtcagctcgtgtcgtgagatgttgggttaagtcccgcaacgagcgcaacccctattgttagttgctaccattaagttgagcactctagcgagactgcctgggataaccaggaggaaggcggggatgacgtcaaatcatcatgccccttatgtctagggctacacacgtgctacaatggcaagtacaaagagatgcaagaccgcgaggtggagctaaactcataaaacttgtctcagttcggattgtaggctgaaactcgcctacatgaagctggagttactagtaatcgcgaatcagaatgtcgcggtgaatacgttcccgggccttgtacacaccgcccgtcacaccatgagagttggcaatacccaacgtccgtgagctaacctgtaagggaggcagcggcctaaggtagggtcagcgattggggtgaagtcgtaacaaggtagccgtaggaga

SEQ ID NO: 585 - DNA, 1483 bp, Clostridium gasigenes
agagtttgatcctggctcaggacgaacgctggcggcgtgcctaacacatgcaagtcgagcgagaggagttcttcggaacgaatctagcggcggacgggtgagtaacacgtgggcaacctaccttatagaggggaatagccttccgaaaggaagattaataccgcataacattgcagtttcgcatgaaacagcaattaaaggagaaatccgctataagatgggcccgcggcgcattagctagttggtgaggtaaaggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaaactctgtctttggggacgataatgacggtacccaaggaggaagccacggctaactacgtgccagcagccgcggtaatacgtaggtggcaagcgttgtccggatttactgggcgtaaagggagcgtaggtggatttttaagtgaggtgtgaaatactcgggctcaacccgagaactgcatttcaaactggaaatctagagtgcaggagaggaaagtggaattcctagtgtagcggtgaaatgcgtagatattaggaagaacaccagtggcgaaggcgactttctggactgtaactgacactgaggctcgaaagcgtggggagcaaacaggattagataccctggtagtccacgccgtaaacgatgaatactaggtgtgggggttgtcatgacctccgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccgtaattggggaagtggcttcggccacaggaagacaggtggtgcatggttgtcgtcagctcgtgtcgtgagatgttgggttaagtcccgcaacgagcgcaacccttattgttagttgccatcatttagttgggcactctagcgagactgcccgggttaaccgggaggaaggtggggatgacgtcaaatcatcatgccccttatgtctagggctacacacgtgctacaatggcaagtacaaagagaagcaagaccgcgaggtggagccaaactataaaacttgtctcagttcggattgcaggctgaaactcgcctgcatgaagctggagttgctagtaatcgcgaatcagcatgtcgcggtgaatacgttcccgggccttgtacacaccgcccgtcacaccacgagagttggcaatacccaaagttcgtgagctaacccgcaagggaggcagcgacctaaggtagggtcagcgattggggtgaagtcgtaacaaggtagccgtaggaga

SEQ ID NO: 586 - DNA, 1359 bp, Clostridium ghonii
tcgagcgaacccttcggggtgagcggcggacgggtgagtaacgcgtgggtaacctgccctgtacacacggataacataccgaaaggtatgctaatacgggataacatatgagagtcgcatggcttttgtatcaaagctccggcggtacaggatggacccgcgtctgattagctagttggtaaggtaacggcttaccaaggcaacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggcggtctttcaagccagaagtgaaaggctacggctcaaccgtagtaagcttttggaactgtaggacttgagtgcaggagaggagagtggaattcctagtgtagcggtgaaatgcgtagatattaggaggaacaccagtagcgaaggcggctctctggactgtaactgacgctgaggcacgaaagcgtggggagcaaacaggattagataccctggtagtccacgccgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccattgacctctccctaatcggagatttcccttcggggacagtggtgacaggtggtgcatggctgtcgtcagctcgtgtcgtgagatgttggggtaagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaagccgtgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttgggggcgcccgaagccggttagctaaccttttaggaagcg

SEQ ID NO: 587 - DNA, 1333 bp, Clostridium glycolicum
ttcggagaagagcggcggacgggtgagtaacgcgtgggtaacctgcctcatacacatggataacataccgaaaggtatgctaatacaggataacataagagattcgcatgtttctcttatcaaagctccggcggtatgagatggacccgcgtctgattagctagttggtaaggtaatggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggtttactgggcgtaaagggtgcgtaggtggtttcttaagtcaggagtgaaaggtacggcttaaccgtagtaagctcttgaaactgggaaacttgagtgcaggagaggaaagtggaattcctagtgtagcggtgaaatgcgtagatattaggaggaacaccagtagcgaaggcggctttctggactgtaactgacactgaggcacgaaagcgtggggagcaaacaggattagataccctggtagtccacgccgtaaacgatgagtactaggtgtcgggggttacccccctcggtgccgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatttttcccttcggggacagaagtgacaggtggggcatgggagtcgtcagctcgtgtcgtgagatgttgggttaagtcccgcaacgagcgcaacccttgcctttagttgccagcattaagttgggcactctagagggactgccagggataacctggaggaaggtggggatgacgtcaaatcatcatgccccttatgcttagggctacacacgtgctacaatgggtggtacagagggcagccaagtcgtgaggccgagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccacggaagttgggggcgcccgaagccacttagctaac

SEQ ID NO: 588 - DNA, 956 bp, Clostridium glycyrrhizinilyticum
  modified_base (907)..(907): a, c, t, g, unknown or other
  modified_base (935)..(935): a, c, t, g, unknown or other
tcgaacgaagcactttaccggatttcttcggaatgaaagttttgtgactgagtggcggacgggtgagtaacgcgtgggtaacctgcctcatacagggggataacagttagaaatgactgctaataccgcataagaccacaggattgcatggtccggtggtaaaaactccggtggtatgagatggacccgcgtctgattaggtagttggtggggtaacggcttaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagaggcaagtctgatgtgaaaacccggggctcaaccccgggactgcattggaaactgtttttctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggaggcaaagcctttcggtgccgcagcaaacgcaataagcagtccacctggggagtacgttcgcaagaatgaaactcaaaggaattgacggggacccgcacaagcggtggagcatgtggtttaattcgaagcaacgcgaagaancttacctgcccttgacatccggctgacnggcgagtaatgtcgcctttcc

SEQ ID NO: 589 - DNA, 1465 bp, Clostridium haemolyticum
gacgaacgctggcggcgtgcctaacacatgcaagtcgagcgatgaaacttccttcgggaagtggattagcggcggacgggtgagtaacacgtgggtaacctgcctcaaagagggggatagcctcccgaaagggagattaataccgcataacattattttatggcatcatagaataatcaaaggagcaatccgctttgagatggacccgcggcgcattagctagttggtgaggtaagggctcaccaaggcgacgatgcgtagccgacctgagagggtgatcggccacattggaactgagacacggtccagactcctacgggaggcagcagtggggaatattgcgcaatgggggaaaccctgacgcagcaacgccgcgtgagtgatgaaggttttcggatcgtaaaactctgtctttagggacgataatgacggtacctaaggaggaagccacggctaactacgtgccagcagccgcggtaatacgtaggtggcaagcgttgtccggatttactgggcgtaaagagtatgtaggtgggtgcttaagtcagatgtgaaattcccgggcttaacctgggcgctgcatttgaaactgggcatctagagtgcaggagaggaaagtggaattcctagtgtagcggtgaaatgcgtagagattaggaagaacaccagtggcgaaggcgactttctggactgtaactgacactgagatacgaaagcgtgggtagcaaacaggattagataccctggtagtccacgccgtaaacgatgaatactaggtgtcggggggtaccaccctcggtgccgcagcaaacgcattaagtattccgcctggggagtacggtcgcaagattaaaactcaaaggaattgacggggacccgcacaagcagcggagcatgtggtttaattcgaagcaacgcgaagaaccttacctagacttgacatctcctgaattactcttaatcgaggaagtcccttcggggacaggaagacaggtggtgcatggttgtcgtcagctcgtgtcgtgagatgttgggttaagtcccgcaacgagcgcaacccttattgttagttgctactattaagttaagcactctaacgagactgccgcggttaacgtggaggaaggtggggatgacgtcaaatcatcatgccccttatgtctagggctacacacgtgctacaatggctggtacaacgagcagcaaacccgcgagggggagcaaaacttgaaagccagtcccagttcggattgtaggctgaaactcgcctacatgaagttggagttgctagtaatcgcgaatcagcatgtcgcggtgaatacgttcccgggtcttgtacacaccgcccgtcacaccatgagagccggtaacacccgaagcccgtgaggtaaccgtaaggagccagcggtcgaaggtgggattggtgattggggtgaagtcgtaacaaggtagccgtaggagaacc

SEQ ID NO: 590 - DNA, 1384 bp, Clostridium hathewayi
  modified_base (19)..(19): a, c, t, g, unknown or other
  modified_base (939)..(939): a, c, t, g, unknown or other
  modified_base (942)..(942): a, c, t, g, unknown or other
  modified_base (980)..(980): a, c, t, g, unknown or other
gtcgagcgaagcggtttcnatgaggttttcggatggatttgaaattgacttagcggcggacgggtgagtaacgcgtgggtaacctgccttacactgggggataacagttagaaatgactgctaataccgcataagcgcacagggccgcatggtccggtgtgaaaaactccggtggtgtaagatggacccgcgtctgattaggtagttggtggggtaacggcccaccaagccgacgatcagtagccgacctgagagggtgaccggccacattgggactgagacacggcccaaactcctacgggaggcagcagtggggaatattggacaatgggcgaaagcctgatccagcgacgccgcgtgagtgaagaagtatttcggtatgtaaagctctatcagcagggaagaaaatgacggtacctgactaagaagccccggctaactacgtgccagcagccgcggtaatacaggggcaagcgtccggattactgggtgtaaagggagcgtaacggtttagcaagttgaagtgaaagcccggggctcaaccccggtactgctttggaaactgttagacttgagtgcaggagaggtaagtggaattctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgtcggggggcaaagcccttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccattgaaaacaagtttatccngantactctgtgcagagggggcgaaaacggtggagcaagtntgaagtcaacgcgtcgtgagatgttgggttaagtcccgcaacgagcgcaacccttatccttagtagccagcgagtagagtcgggcactctggggagactgccagggataacctggaggaaggtggggatgacgtcaaatcatcatgccccttatgatttgggctacacacgtgctacaatggcgtaaacaaagggaggcaaaggagcgatccggagcaaaccccaaaaataacgtctcagttcggattgcaggctgcaactcgcctgcatgaagctggaatcgctagtaatcgcgaatcagaatgtcgcggtgaatacgttcccgggtcttgtacacaccgcccgtcacaccatgggagttggtaacgcccgaagtcagtgacccaaccgcaaggagggagctg

SEQ ID NO: 591 - DNA, 1393 bp, Clostridium hiranonis
acatgcaagtcgagcgattctcttcggagaagagcggcggacgggtgagtaacgcgtgggtaacctgccctgtacacacggataacataccgaaaggtatgctaatacgggataatatataagagtcgcatgacttttatatcaaagatttttcggtacaggatggacccgcgtctgattagcttgttggcggggtaacggcccaccaaggcgacgatcagtagccgacctgagagggtgatcggccacattggaactgagacacggtccaaactcctacgggaggcagcagtggggaatattgcacaatgggcgcaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagttaaaggctacggctcaaccgtagtaagctcctgatactgtctgacttgagtgcaggagaggaaagcggaattcccagtgtagcggtgaaatgcgtagatattgggaggaacaccagtagcgaaggcggctttctggactgtaactgacgctgaggcacgaaagcgtggggagcaaacaggattagataccctggtagtccacgctgtaaacgatgagtactagttgtcggaggttaccccttcggtgccgcagctaacgcattaagtactccgcctggggagtacgcacgcaagtgtgaaactcaaaggaattgacggggacccgcacaagtagcggagcatgtggtttaattcgaagcaacgcgaagaaccttacctaggcttgacatccttctgaccgaggactaatctcctctttccctccggggacagaagtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcctagggctacacacgtgctacaatgggtggtacagagggcagccaagccgtgaggtggagcaaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttggagacacccgaagccgactatctaaccttttgggagaagtcgtccccctcgaatcaatacccc

SEQ ID NO: 592 - DNA, 1460 bp, Clostridium histolyticum
gacgaacgctggcggcgtgcttaacacatgcaagtcgagcgatgaagttcccttcggggaacggattagcggcggacgggtgagtaacacgtgggtaacctgcctcaaagagggggatagcctcccgaaagggagattaataccgcataatatctttttaatgcatgttagaaagattaaaggagcaatccgctttgagatggacccgcggcgcattagctagttggtgaggtaacggctcaccaaggcgacgatgcgtagccgacctgagagggtgatcggccacattgggactgagacacggcccagactcctacgggaggcagcagtggggaatattgcgcaatgggggaaaccctgacgcagcaacgccgcgtgagtgatgaaggtcttcggatcgtaaagctctgtcttcagggacgataatgacggtacctgaggaggaagccacggctaactacgtgccagcagccgcggtaatacgtaggtggcaagcgttgtccggatttattgggcgtaaagcatgcgtaggcggatatttaagtgggatgtgaaatcccggggcttaaccccggtgctgcatttcaaactggatatctagagtgcaggagaggaaagcggaattcctagtgtagcggtgaaatgcgtagatattaggaagaacaccagtggcgaaggcggctttctggactgtaactgacgctgaggcatgaaagcgtgggtagcaaacaggattagataccctggtagtccacgccgtaaacgatgggtactaggtgtcggggtttcaatactccggtgccgcagttaacacattaagtaccccgcctggggagtacgatcgcaagattaaaactcaaaggaattgacgggggcccgcacaagtagcggagcatgtggtttaattcgaagcaacgcgaagaaccttacctgggcttgacatcccgagaatcctgtggaaacataggagtgcccttcggggaactcggtgacaggtggtgcatggttgtcgtcagctcgtgtcgtgagatgttgggttaagtcccgcaacgagcgcaaccctttgttgttagttgctaccattaagttgagcactctagcaagactgcctgggtaaccaggaggaaggtggggatgacgtcaaatcatcatgccccttatgtccagggctacacacgtgctacaatggttggtacagagagaagcaagaccgtgaggtggagccaatctcacaaagccaatctcagttcggattgtaggctgcaactcgcctacatgaagctggagttactagtaatcgcgaatcagaatgtcgcggtgaatgcgttcccgggccttgtacacaccgcccgtcacaccatgagagttggtaacacccgaagtccgtgaggtaaccgtaaggagccagcggccgaaggtgggatcgatgattggggtgaagtcgtaacaggtaaccgtaa

SEQ ID NO: 593 - DNA, 1400 bp, Clostridium hylemonae
tcgaacgaagcaatactgtgtgaagagattagcttgctaagatcagaactttgtattgactgagtggcggacgggtgagtaacgcgtgggcaacctgccttacacagggggataacagctagaaatggctgctaataccgcataagacctcagtaccgcatggtagaggggtaaaaactccggtggtgtaagatgggcccgcgtctgattaggtagttggtagggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaagatgacggtaccgactaagaagccggctaactacgtgccacagccgcggtaatacgtagggggcaagcgttatccggatttactgggtgtaaagggagcgtagacggcatggcaagtctgaagtgaaagcccggggctcaaccccgggactgctttggaaactgtcaggctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgattactaggtgtcgggaagcaaagcttttcggtgccgcagccaacgcaataagtaatccacctggggagtacgttcgcaagaatgaaactcaaaggaattgacggggacccgcacaagcggtggagcatgtggtttaattcgaagcaacgcgaagaaccttacctgatcttgacatccccggcatgaaaagtctgaagtactctttcttcggaacaccggtgacaggtggtgcatggttgtcgtcagctcgtgtcgtgagatgttgggttaagtcccgcaacgagcgcaacccttatctttagtagccagcatttgaggtgggcactctagagagactgccagggataacctggaggaaggtggggatgacgtcaaatcatcatgccccttatgaccagggctacacacgtgctacaatggcgtaaacaaagggaagcgaccctgtgaaggcaagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagccggtgacctaaccgaaaggaaggagccg

SEQ ID NO: 594 - DNA, 994 bp, Clostridium indolis
  modified_base (944)..(944): a, c, t, g, unknown or other
  modified_base (961)..(961): a, c, t, g, unknown or other
cggatggaattccttaatgactgagtggcggacgggtgagtaacgcgtggggaacctgccctatacagggggataacagctggaaacggctgctaataccgcataagcgcacagaatcgcatgattcggtgtgaaaagctccggcagtataggatggtcccgcgtctgattagctggttggcggggtaacggcccaccaaggcgacgatcagtagccggcttgagagagtggacggccacattgggactgagacacggcccaaactcctacgggaggcagcagtggggaatattgcacaatggggggaaccctgatgcagcgacgccgcgtgagtgaagaagtatttcggtatgtaaagctctatcagcagggaagaaaaaagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatctaactgaccggttcgtaatgggacctttccttcgggacagttanacaggtggtgcatggtngtcgtcagctcgtgtcgtgagatgttgggttaa

SEQ ID NO: 595 - DNA, 1401 bp, Clostridium innocuum
  modified_base (15)..(16): a, c, t, g, unknown or other
  modified_base (1395)..(1395): a, c, t, g, unknown or other
tcgaacgaagtcttnnggaagcttgcttccaaaaagacttagtggcgaacgggtgagtaacacgtaggtaacctgcccatgtgtccgggataactgctggaaacggtagctaaaaccggataggtatacggagcgcatgctctgtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacacagtgatgtgaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagngagccg

SEQ ID NO: 596 - DNA, 310 bp, Clostridium irregulare
  modified_base (44)..(44): a, c, t, g, unknown or other
  modified_base (59)..(59): a, c, t, g, unknown or other
  modified_base (265)..(266): a, c, t, g, unknown or other
gacccgcgtctgattagctagttggtaaggtaacggcttaccanggcgacgatcactanccgacctgagagggtgatcggccacattggaactgaaacacggtccaaactcctacgggaggcagcagtggggaatattgcacaatgggcgaaagcctgatgcaccaacgccgcgtgagcgatgaaggccttcgggtcgtaaagctctgtcctcaaggaagataatgacggtacttgaagaggaagccccggctaactacgtgccnncagccgcggtaatacgtagggggctagcgttatccggaattact

SEQ ID NO: 597 - DNA, 1023 bp, Clostridium isatidis
  modified_base (923)..(923): a, c, t, g, unknown or other
  modified_base (940)..(940): a, c, t, g, unknown or other
  modified_base (967)..(967): a, c, t, g, unknown or other
cgaggtgattccttcgggaatgaacctagcggcggacgggtgagtaacacgtgggtaacctgccttatagaggggaatagcctcccgaaagggagattaataccgcataatattgaagcttcgcatgaagtttcaatcaaaggagcaatccgctataagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtcttcagggacgataatgacggtacctgaggaggaagccacggctaactacgtgccagcagccgcggtaatacgtaggtggcgagcgttgtccggatttactgggcgtaaagggagcgtaggcggacttttaagtgagatgtgaaatactcgggctcaacccgggggctgcatttcaaactgaaagtctagagtgcaggagaggagagtggaattcctagtgtagcggtgaaatgcgtagagattaggaagaacaccagtggcgaaggcggctctctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgcattacccttaanccggggaagtcccttcngggacaggatgacaggtggtgcatggntgtcgtcagctcgtgtcgtgagatgttgggttaagtcccgcaacgagcgcaacccc

SEQ ID NO: 598 - DNA, 1462 bp, Clostridium kluyveri
ttaaaataagagtttgatcctggctcaggacgaacgctggcggcgtgcctaacacatgcaagtcgagcgaggaagccccttcgggggtggaatagcggcggacgggtgagtaacacgtgggtaacctgcctcaaagagggggatagcctcccgaaagggagattaataccgcatagaaggtaaaaatcgcatgataaatgccttaaaggagcaatccgctttgagatgggcccgcgtcgcattagctagttggagggataaaagccccccaaggcgacgatgcgtagccgacctgagagggtgaacggccacattggaactgagatacggtccagactcctacgggaggcagcagtggggaatattgcacaatgggggaaaccctgatgcagcaacgccgcgtgagtgaagaaggttttcggatcgtaaagctctgtcatccgggacgataatgacggtaccggaagaggaagccacggctaactacgtgccagcagccgcggtaatacgtaggtggcgagcgttgtccggaattactgggcgtaaagggtgtgcaggcggatatttaagtgagatgtgaaagacccgggcttaacccgggcagtgcatttcaaactggatatctagagtgcaggagaggagaacggaattcctagtgtagcggtgaaatgcgtagagattaggaagaacaccagtggcgaaggcggttctctggactgtaactgacgctgaggcacgaaagcgtgggtagcaaacaggattagataccctggtagtccacgccgtaaacgatgagtactaggtgtagggggtatcgaccccccctgtgccgcagtaaacacaataagtactccgcctgggaagtacgatcgcaagattaaaactcaaaggaattgacggggacccgcacaagcagcggagcatgtggtttaattcgaagcaacgcgaagaaccttacctggacttgacatcccctgaatgactcgtaatggaggaagccctacggggcagggagacaggtggtgcatggttgtcgtcagctcgtgtcgtgagatgttaggttaagtcctgcaacgagcgcaacccctgtcgttagttgccagcacgtaaaggtgggcaccctaacgagactgccgcggttaacgtggaggaaggtggggatgacgtcaaatcatcatgccccttatgtccagggcaacacacgtgctacaatgggcagaacagagagaagcaataccgcgaggaggagcaaatctcaaaaactgcccccagttcggattgcaggctgaaacccgcctgcatgaagttggagttgctagtaatcgcgaatcagcatgtcgcggtgaatacgttcccgggtcttgtacacaccgcccgtcacaccatgagagctggcaacacccgaagtccgtagtctaaccaaggaggacgcggccgaaggtggggttagtgattggggtga

SEQ ID NO: 599 - DNA, 1361 bp, Clostridium lactatifermentans
agagcttcggcaggatttctatctatcttagtggcggacgggtgagtaacgtgtgggcaacctgccctgtactggggaataatcattggaaacgatgactaataccgcatgtggtcctcggaaggcatcttctgaggaagaaaggatttattcggtacaggatgggcccgcatctgattagctagttggtgagataacagcccaccaaggcgacgatcagtagccgacctgagagggtgatcggccacattgggactgagacacggcccaaactcctacgggaggcagcagtggggaatattgcacaatgggcgaaagcctgatgcagcaacgccgcgtgaaggatgaagggtttcggctcgtaaacttctatcaatagggaagaaataaatgacggtacctaaataagaagccccggctaactacggccagcagccgcggtaatactagggggcaagcgttatccggaattactgggtgtaaagggagcgtaggcggcatggtaagccagatgtgaaagccttgggcttaacccgaggattgcatttggaactatcaagctagagtacaggagaggaaagcggaattcctagtgtagcggtgaaatgcgtagatattaggaagaacaccagtggcgaaggcggctttctggactgaaactgacgctgagctcgaaagcgtggggagcaaacaggattagataccctggtagtccacgccgtaaacgatgagtgctaggtgtcggggaggaatcctcggtgccgcagctaacgcaataagcactccacctggggagtacgaccgcgaggttgaaactcaaaggaattgacgggggcccgcacaagcggtggagcatgtggtttaattcgaagcaacgcgaagaaccttaccaaggcttgacatcccgatgaccgctctagagatagagcttctcttcgtagcatcggtgaccgggggtgcatgggagtcgtcagctcgtgtcgtgagatgttgggttaagtcccgcaacgagcgcaacccttatcttcagtagccatcattcagttgggcactctggagagactgccgtggataacacggaggaaggtggggatgacgtcaaatcatcatgccccttatgtcttgggctacacacgtgctacaatggctggtaacaaagtgacgcaagacggcgacgttaagcaaatcacaaaaacccagtcccagttcggattgtagtctgcaactcgactacatgaagctggaatcgctagtaatcgcgaatcagcatgtcgcggtgaatacgttcccgggccttgtacacaccgcccgtcacaccatgggagttggaagcacccgaagtcggtgacctaaccgtaagg

SEQ ID NO: 600 - DNA, 1381 bp, Clostridium lavalense
  modified_base (17)..(19): a, c, t, g, unknown or other
tcgaacgaagcattttnnnatgaagttttcggatggattctgagatgactgagtggcggacgggtgagtaacacgtggataacctgcctcacactgggggacaacagttagaaatgactgctaataccgcataagcgcacagtaccgcatggtacagtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgcctttccttcgggacaagagagacaggtggtgcatggttgtcgtcagctcgtgtcgtgagatgttgggttaagtcccgcaacgagcgcaacccttatccttagtagccagcaataagatgggcactctagggagactgccagggacaacctggaggaaggtggggatgacgtcaaatcatcatgccccttatgatttgggctacacacgtgctacaatggcgtaaacaaagggaagcgaccctgcgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgca

SEQ ID NO: 601 - DNA, 1505 bp, Clostridium leptum
cgacgctggcggcgtgcctaacacatgcaagtcgaacggagttaaattcgacacccgagtatccggccgggaggcggggtgctgggggttggatttaacttagtggcggacgggtgagtaacgcgtgagtaacctgcctttcagagggggataacgttctgaaaagaacgctaataccgcataacatcaatttatcgcatgataggttgatcaaaggagcaatccgctggaagatggactcgcgtccgattagccagttggcggggtaacggcccaccaaagcgacgatcggtagccggactgagaggttgaacggccacattgggactgagacacggcccagactcctacgggaggcagcagtgggggatattgcacaatgggggaaaccctgatgcagcaacgccgcgtgagggaagaaggttttcggattgtaaacctctgttcttagtgacgataatgacggtagctaaggagaaagctccggctaactacgtgccagcagccgcggtaatacgtagggagcgagcgttgtccggatttactgggtgtaaagggtgcgtaggcggcgaggcaagtcaggcgtgaaatctatgggcttaacccataaactgcgcttgaaactgtcttgcttgagtgaagtagaggtaggcggaattcccggtgtagcggtgaaatgcgtagagatcgggaggaacaccagtggcgaaggcggcctactgggctttaactgacgctgaagcacgaaagcatgggtagcaaacaggattagataccctggtagtccatgccgtaaacgatgattactaggtgtggggggtctgaccccctccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccgtctaacgaagcagagatgcattaggtgcccttcggggaaaggcgagacaggtggtgcatggttgtcgtcagctcgtgtcgtgagatgttgggttaagtcccgcaacgagcgcaacccttgtttctagttgctacgcaagagcactctagagagactgccgttgacaaaacggaggaaggtggggacgacgtcaaatcatcatgccccttatgacctgggccacacacgtactacaatggctgtaaacagagggaagcaaagccgcgaggtggagcaaaaccctaaaagcagtcccagttcggatcgcaggctgcaacccgcctgcgtgaagtcggaattgctagtaatcgcggatcagcatgccgcggtgaatacgttcccgggccttgtacacaccgcccgtcacaccatgggagccggtaatacccgaagccagtagttcaaccgcaaggagagcgctgtcgaaggtaggattggcgactggggtgaagtcgtaacaaggtagccgtatcggaaggtgcggc

SEQ ID NO: 602 - DNA, 1500 bp, Clostridium limosum
tggctcaggacgaacgctggcggcgtgcttaacacatgcaagtcgagcgatgaagcttccttcgggaagtggattagcggcggacgggtgagtaacacgtgggtaacctgcctcaaagagggggatagccttccgaaaggaagattaataccgcataatatcatttcaatgcatgttgaaatgattaaaggagtaatccgctttgagatggacccgcggcgcattagctagttggtgaggtaacggctcaccaaggcgacgatgcgtagccgacctgagagggtgatcggccacattgggactgagacacggcccagactcctacgggaggcagcagtggggaatattgcgcaatgggggaaaccctgacgcagcaacgccgcgtgagtgatgacggtcttcggattgtaaagctctgttttcagggacgataatgacggtacctgaggaggaagccacggctaactacgtgccagcagccgcggtaatacgtaggtggcgagcgttgtccggatttattgggcgtaaagcatgcgtaggcggatacttaagtgggatgtgaaatcccggggctcaaccccggtgctgcattccaaactgggtatctagagtacaggagaggaaagcggaattcctagtgtagcggtgaaatgcgtagagattaggaagaacaccagtggcgaaggcggctttctggactgtaactgacgctgaggcatgaaagcgtgggtagcaaacaggattagataccctggtagtccacgccgtaaacgatgagtactaggtgtcggggtttcaatacttcggtgccgcagttaacacattaagtactccgcctgggaagtacgatcgcaagattaaaactcaaaggaattgacgggggcccgcacaagtagcggagcatgtggtttaattcgaagcaacgcgaagaaccttacctgggcttgacatcccaagaatcctgtggaaacacgggagtgcccttcggggaacttggtgacaggtggtgcatggttgtcgtcagctcgtgtcgtgagatgttgggttaagtcccgcaacgagcgcaacccttgttgttagttgctaccattaagttgagcactctagcaagactgcctgggtaaccaggaggaaggtggggatgacgtcaaatcatcatgccccttatgtccagggctacacacgtgctacaatggttggtacaaagagaagcaagaccgtgaggtggagcaaatctcataaaaccaatctcagttcggattgtaggctgaaactcgcctacatgaagctggagttactagtaatcgcgaatcagaatgtcgcggtgaatgcgttcccgggccttgtacacaccgcccgtcacaccatgagagttggtaacacccgaagtccgtgaggtaaccgcaaggagccagcggccgaaggtgggatcgatgattggggtgaagtcgtaacaaggtagccgtaggagaacctgcggctggatcacctcctttctga

SEQ ID NO: 603 - DNA, 1387 bp, Clostridium magnum
  modified_base (816)..(816): a, c, t, g, unknown or other
ggacgggtgagtaacacgtgggtaacctgcctcaaagagggggatagcctcccgaaagggagattaataccgcataacattagtttttcgcatgaagaactaattaaaggagtaatccgctttgagatggacccgcggcgcattagctagttggtgaggtaaaggctcaccaaggcgacgatgcgtagccgacctgagagggtgatcggccacattggaactgagacacggtccagactcctacgggaggcagcagtggggaatattgcacaatgggcgaaagcctgatgcagcaacgccgcgtgagtgatgaaggccttcgggttgtaaagctctgtcttttgggacgataatgacggtaccaaaggaggaagccacggctaactacgtgccagcagccgcggtaatacgtaggtggcgagcgttgtccggatttactgggcgtaaaggtagcgtaggcggatatttaagtgagatgtgaaatacccgagcttaacttgggtagctgcatttcaaactggatatctagagtgcgggagaggagaatggaattcctagtgtagcggtgaaatgcgtagagattaggaagaacaccagtggcgaaggcgattctctggaccgtaactgacgctgaggcatgaaagcgtgggtagcaaacaggattagataccctggtagtccacgccgtaaacgatgagtactaggtgtaggagggtccaaccttctgtgccgcagttaacacaataagtactccgcctgggaagtacgatcgcaagattaaaactcaaaggaattgacgggggcccgcacaagcanggacatgtggtttaattcgaagcaacgcgaagaaccttacctggacttgacatcccctgaatagtgcagagatgcatgaagcttcgggcaggagacaggtggtgcatggttgtcgtcagctcgtgtcgtgagatgttaggttaagtcctgcaacgagcgcaacccctatcattagttgctaccattaagttgagcactctagtgagactgcccgggttaaccgggaggaaggtggggatgacgtcaaatcatcatgccccttatgccagggctacacacgtgctacaatggtaggtacagagagatgcaagaccgcgaggtggagcaaaactcaaaaacctatcccagttcggattgtaggctgcaactcgcctacatgaagccggagttgctagtaatcgcgaatcagaatgtcgcggtgaatacgttcccgggccttgtacacaccgcccgtcacaccatgagagctggcaacacccgaagtccgtgaggtaaccgtgaaaggagccagcggaaaggtggggttagtgattggggtgaagtcgtaacaaggtagccgtaggactcgctg

SEQ ID NO: 604 - DNA, 1498 bp, Clostridium malenominatum
gtttgatcctggctcaggacgaacgctggcggcgtgcctaacacatgcaagtcgagcgatgatatcccttcggggattgattagcggcggacgggtgagtaacacgtgggtaacctgcctcaaagagggggatagccctccgaaaggaggattaataccgcataaagttgagagttcgcatgaacattcaaccaaaggagcaatccgctttgagatggacccgcgtcccattagctagttggtgaggtaatagctcaccaaggcgacgatgggtagccgacctgagagggtgatcggccacattggaactgagatacggtccagactcctacgggaggcagcagtggggaatattgcgcaatgggggaaaccctgacgcagcaacgccgcgtgggcgacgaaggtcttcggattgtaaagccctgtcttctgggacgataatgacggtaccagaggaggaagccacggctaactacgtgccagcagccgcggtaatacgtaggtggcaagcgttgtccggaattactgggcgtaaagggtgcgtaggcggatatttaagtgggatgtgaaatacctgagctcaactcgggtgctgcattccaaactggatatctagagtgcaggagaggagaatggaattcctagtgtagcggtgaaatgcgtagagattaggaagaacaccagtggcgaaggcgattctctggactgtaactgacgctgaggcacgaaagcgtgggtagcaaacaggattagataccctggtagtccacgccgtaaactatgaatactaggtgtaggggggaacctccctctgtgccgcagttaacacaataagtattccgcctggggagtacggtcgcaagactaaaactcaaaggaattgacgggggcccgcacaagcagcggagcatgtggtttaattcgaagcaacgcgaagaaccttacctgaacttgacatcccctgcattactcgtaatggaggaaatcccttcggggacagggagacaggtggtgcatggttgtcgtcagctcgtgtcgtgagatgttgggttaagtcccgcaacgagcgcaacccttattattagttgctaccattaagttgagcactctaatgagactgcccgggttaaccgggaggaaggtggggatgacgtcaaatcatcatgccccttatgttcagggctacacacgtgctacaatggtgagaacaacgagacgcaagaccgcaaggtggagcaaacctcaaaaactcatcccagttcggattgtaggctgaaactcgcctacatgaagccggagttgctagtaatcgcgaatcagcatgtcgcggtgaatacgttcccgggccttgtacacaccgcccgtcacaccatgagagttggcaacacccgaagtccgtgaggtaaccgtaaggagccagcggccgaaggtggggtcaatgattggggtgaagtcgtaacaaggtagccgtaggagaacctgcggctggatcacctcc

SEQ ID NO: 605 - DNA, 1347 bp, Clostridium mayombei
tcgagcgattctcttcggagaagagcggcggacgggtgagtaacgcgtgggtaacctgcctcatacacatggataacataccgaaaggtatgctaatacaggataacataagagattcgcatgtttctcttatcaaagctccggcggtatgagatggacccgcgtctgattagctagttggtaaggtaatggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggtggtttcttaagtcaggagtgaaaggtacggcttaaccgtagtaagctcttgaaactgggaaacttgagtgcaggagaggaaagtggaattcctagtgtagcggtgaaatgcgtagatattaggaggaacaccagtagcgaaggcggctttctggactgtaactgacactgaggcacgaaagcgtggggagcaaacaggattagataccctggtagtccacgccgtaaacgatgagtactaggtgtcgggggttacccccctcggtgccgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatttttcccttcggggacagaagtgacaggtggtgcatggatgtcgtcagctcgtgtcgtgagatgttgggttaagtcccgcaacgagcgcaacccttgcctttagttgccagcattaagttgggcactctagagggactgccagggataacctggaggaaggtggggatgacgtcaaatcatcatgccccttatgcttagggctacacacgtgctacaatgggtggtacagagggcagccaagtcgtgaggccgagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccacggaagttgggggcgcccgaagcctacttagctaa

SEQ ID NO: 606 - DNA, 1363 bp, Clostridium methylpentosum
ttgttttggtgaagcccttcggggtggaaccggctcaacttagtggcggacgggtgagtaacacgtgagcaacctgccttacagaggggaataacgtttggaaacgaacgctaataccgcataacataacgggatcgcatgattttgttatcaaagattttatcgctgtaagatgggctcgcgtctgattagatagttggtgaggtaatggctcaccaagtcgacgatcagtagccggactgagaggttgaacggccacattgggactgagacacggcccagactcctacgggaggcagcagtggggaatattgcacaatgggggaaaccctgatgcagcgacgccgcgtgaaggaagaaggccttcgggttgtaaacttctgtcttcagggacgataatgacggacctgggggaagctccggctaactacgtgccagcagccgcggtaatacgtagggagcgagcgttgtccggaattactgggtgtaaagggagcgtaggcgggattgcaagttgaatgtgaaatctatgggcttaacccataaactgcgttcaaaactgcagttcttgagtgaagtagaggcaggcggaattcctagtgtagcggtgaaatgcgtagatattaggaggaacaccagtggcgaaggcggcctgctgggctttaactgacgctgaggctcgaaagcgtgggtagcaaacaggattagataccctggtagtccacgctgtaaacgatgattactaggtgtaggggggtcaaccttctgtgccggagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccaactaacgaagtagagatacattagacgcccttcggggaaagttgagacaggtggagcatgggcgtcgtcagctcgtgtcgtgagatgttgggttaagtcccgcaacgagcgcaacccttacatttagttgctacgcaagagcactctagatggactgccgttgacaaaacggaggaaggtggggatgacgtcaaatcatcatgccccttatgacctgggctacacacgtactacaatggctattaacagagggaagcaatactgtgaagtggagcaaacccctaaaaatagtctcagttcggattgtaggctgcaactcgcctacatgaagccggaattgctagtaatcgcggatcagcatgccgcggtgaatacgttcccgggccttgtacacaccgcccgtcacaccatgagagttggcaacacccgaagtcagtagtctaaccgc

SEQ ID NO: 607 - DNA, 1392 bp, Clostridium nexile
tcgaacgaagcgcttaaatggatttcttcggattgaagtttttgtgactgagtggcggacgggtgagtaacgcgtgggtaacttgcctcatacagggggataacagttagaaatgactgctaataccgcataagcgcacagtgctgcatggcacagtgtgaaaaactccggtggtatgagatggacccgcgtctgattagctagttggtggggtaacggcctaccaaggcgacgatcagtagccggcctgagagggtgaacggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggttgtgtaagtctgatgtgaaagcccggggctcaaccccgggactgcattggaaactatgtaactagagtgtcggagaggtaagcggaattcctagtgtagcggtgaaatgcgtagatattaggaggaacaccagtggcgaaggcggcttactggacgatcactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctggtcttgacatcccggtgaccggcaagtaatgttgcctttccttcgggacaccggtgacaggtggtgcatggttgtcgtcagctcgtgtcgtgagatgttgggttaagtcccgcaacgagcgcaacccctatcttcagtagccagcatttaaggtgggcactctggagagactgccagggataacctggaggaaggtggggatgacgtcaaatcatcatgccccttatgaccagggctacacacgtgctacaatggcgtaaacaaagggaagcgaacctgtgaggggaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagtcagtaacgcccgaagtcagtgacccaaccgtaaggagggagctg

SEQ ID NO: 608 - DNA, 1493 bp, Clostridium novyi
gagagtttgatcctggctcaggacgaacgctggcggcgtgcctaacacatgcaagtcgagcgatgaagcttccttcgggaagtggattagcggcggacgggtgagtaacacgtgggtaacctgcctcaaagagtgggatagcctcccgaaagggagattaataccgcataacattattttacggcatcgtagaataatcaaaggagcaatccgctttgagatggacccgcggcgcattagctagttggtgaggtaacggctcaccaaggcaacgatgcgtagccgacctgagagggtgatcggccacattggaactgagacacggtccagactcctacgggaggcagcagtggggaatattgcgcaatgggggaaaccctgacgcagcaacgccgcgtgagtgatgaaggttttcggatcgtaaaactctgtcattagggacgataatgacggtacctaatgaggaagccacggctaactacgtgccagcagccgcggtaatacgtaggtggcaagcgttgtccggatttactgggcgtaaagagtatgtaggtgggcatttaagtcagatgtgaaattcccgggcttaacctgggagctgcatttgatactgggtgtctagagtgcaggagaggaaagtggaattcctagtgtagcggtgaaatgcgtagagattaggaagaacaccagtggcgaaggcgactttctggactgtaactgacactgagatacgaaagcgtgggtagcaaacaggattagataccctggtagtccacgccgtaaacgatgaatactaggtgtcggggggtaccaccctcggtgccgcagcaaacgcattaagtattccgcctggggagtacggtcgcaagattaaaactcaaaggaattgacggggacccgcacaagcagcggagcatgtggtttaattcgaagcaacgcgaagaaccttacctagacttgacatctcctgaattactcgtaactgaggaagtcccttcggggacaggaagacaggtggtgcatggttgtcgtcagctcgtgtcgtgagatgttgggttaagtcccgcaacgagcgcaacccttattgttagttgctactattaagttaagcactctaacgagactgccgcggttaacgtggaggaaggtggggatgacgtcaaatcatcatgccccttatgtctagggctacacacgtgctacaatggctggtacaacgagcagcaatcccgcgagggggagcaaaacttgaaagccagtcccagttcggattgtaggctgaaactcgcctacatgaagttggagttgctagtaatcgcgaatcagcatgtcgcggtgaatacgttcccgggtcttgtacacaccgcccgtcacaccatgagagccggtaacacccgaagcccgtgaggtaaccgtaaggagccagcggtcgaaggtgggattggtgattggggtgaagtcgtaacaaggtagccgtaggagaacctgcggct

SEQ ID NO: 609 - DNA, 1391 bp, Clostridium orbiscindens
  modified_base (16)..(16): a, c, t, g, unknown or other
tcgaacggggtgctcntgacggaggattcgtccaacggattgagttacctagtggcggacgggtgagtaacgcgtgaggaacctgccttggagaggggaataacactccgaaaggagtgctaataccgcatgatgcagttgggtcgcatggctctgactgccaaagatttatcgctctgagatggcctcgcgtctgattagctagtaggcggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcggggacgaaacaaatgacggtacccgacgaataagccacggctaactacgtgccagcagccgcggtaatacgtaggtggcaagcgttatccggatttactgggtgtaaagggcgtgtaggcgggattgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccaggtgtgtgtaaccggcgagtgaagcagagatgcattaggtgcccttcggggaaagtggagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaggcaataccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgc

SEQ ID NO: 610 - DNA, 1342 bp, Clostridium oroticum
cggattgaaagagtgttgcgactgagcggcggacgggtgagtaacgcgtgggtaacctgcctcatacagggggataacagttagaaatgactgctaataccgtataagaccacggtgccgcatggcacagtggtaaaaactccggtggtatgagatggacccgcgtctgattagctagttggtagggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgggggagcgcggatttactgggtgtaaagggagcgtagacggtgatgcaagttgatgtgaaaacccggggctcaaccccgggactgcattggaaactgtgtgactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgaatactaggtgtcgggtggcaaagccattcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctgctcttgacatcccgctgagctgtcaaggaagcggacatgccgttgggggtgtggagacaggtggtgcatggttgtcgtcagctcgtgtcgtgagatgttgggttaagtcccgcaacgagcgcaacccttatctttagtagccagcggtcaggccgggcactctagagagactgccagggataacctggaggaaggtggggatgacgtcaaatcatcatgccccttatgagcagggctacacacgtgctacaatggcgtaaacaaagggaggcaatactgtgaagtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgc

SEQ ID NO: 611 - DNA, 1377 bp, Clostridium paraputrificum
gtcgagcgatgaagttccttcgggaacggattagcggcggacgggtgagtaacacgtgggcaacctgccttatagaggggaatagccttccgaaaggaagattaataccgcataagattgtagcttcgcatgaagcagcaattaaaggagcaatccgctataagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaagctctgtctttggggacgataatgacggtacccaaggaggaagccacggctaactacgtgccagcagccgcggtaatacgtaggtggcaagcgttgtccggatttactgggcgtaaagggagcgtaggcggatttttaagtgggatgtgaaatacccgggctcaacctgggtgctgcattccaaactggaaatctagagtgcaggaggggaaagtggaattcctagtgtagcggtgaaatgcgtagagattaggaagaacaccagtggcgaaggcgactttctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagtagcggagcatgtggtttaattcgaagcaacgcgaagaaccttacctagacttgacatctcctgaattaccatgtaatgtgggaagtcccttcggggacaggaagacaggtggtgcatgggtgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggccggtacaacgagatgcaataccgtgaggtggagcaaaactataaaaccggtctcagttcggattgtaggctgaaactcgcctacatgaagctggagttactagtaatcgcgaatcagaatgtcgcggtgaatacgttcccgggccttgtacacaccgcccgtcacaccatgagagttggcaatacccaaagttggtgatctaacccgtaagggaggaagcca

SEQ ID NO: 612 - DNA, 1374 bp, Clostridium perfringens
tcgagcgatgaagtttccttcgggaaacggattagcggcggacgggtgagtaacacgtgggtaacctgcctcatagagtggaatagccttccgaaaggaagattaataccgcataatgttgaaagatggcatcatcattcaaccaaaggagcaatccgctatgagatggacccgcggcgcattagctagttggtggggtaacggcctaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtctttggggaagataatgacggtacccaaggaggaagccacggctaactacgtgccagcagccgcggtaatacgtaggtggcgagcgttatccggatttactgggcgtaaagggagcgtaggcggatgattaagtgggatgtgaaatacccgggctcaacttgggtgctgcattccaaactggttatctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtgggggtttcaacacctccgtgccgccgctaacgcattaagtattccgcctggggagtacggtcgcaagattaaaactcaaaggaattgacggggacccgcacaagtagcggagcatgtggtttaattcgaagcaacgcgaagaaccttacctacacttgacatcccttgcattactcttaatcgaggaggaccattaggggggatgggaaatagccgggctcaacttgggtcagctcgtgtcgtgagatgttgggttaagtcccgcaacgagcgcaacccttgtcgttagttactaccattaagttgaggactctagcgagactgcctgggttaaccaggaggaaggtggggatgacgtcaaatcatcatgccccttatgtgtagggctacacacgtgctacaatggctggtacagagagatgcaataccgcgaggtggagccaaacttaaaaaccagtctcagttcggattgtaggctgaaactcgcctacatgaagctggagttactagtaatcgcgaatcagaatgtcgcggtgaatacgttcccgggtcttgtacacaccgcccgtcacaccatgagagttggcaatacccgaagtccgtgagctaaccgcaaggaggcagcgg

SEQ ID NO: 613 - DNA, 1523 bp, Clostridium phytofermentans
agagtttgatcctggctcaggatgaacgctggcggcgtgcttaacacatgcaagtcgaacggagtttttaaatggaagtcctcggatggaagtttagaaacttagtggcggacgggtgagtaacgcgtgggtaacctgcctcatacagggggataacagtcggaaacgattgctaaaaccgcataacatagcgaaaccgcatgattttgctatcaaatatttataggtatgagatggacccgcgtctgattagctagttggtggggtaatggcctaccaaggcgacgatcagtagccggcttgagagagtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtaggtggtaggtcaagtcagatgtgaaagcccagggctcaaccctgggactgcatttgaaactggcttactagagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactagctgtcggggctatcatggcttcggtggcgcagctaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgacaaccgagtaacgtcggtcttccttcgggacagaggtgacaggtggtgcatggttgtcgtcagctcgtgtcgtgagatgttgggttaagtcccgcaacgagcgcaacccctatctttagtagccagcagttcggctgggcactctagagagactgccagggataacctggaggaaggcggggatgacgtcaaatcatcatgccccttatgatttgggctacacacgtgctacaatggtgactacaaagagaagcaagcctgcgagggggagcaaatctcaaaaaggtcatcccagttcggattgtactctgcaactcgagtacatgaagctggaatcgctagtaatcgcgaatcagaatgtcgcggtgaatacgttcccgggtcttgtacacaccgcccgtcacaccatgggagtaggtaacgcccgaagtcagtgacccaaccgtaaggagggagctgccgaaggcgggatctataactggggtgaagtcgtaacaaggtagccgtatcggaaggtgcggctggatcacctccttt

SEQ ID NO: 614 - DNA, 1482 bp, Clostridium piliforme
agagtttgatcatggctcaggatgaacgctggcggcgtgcctaacacatgcaagtcgagcggggatataatagcgttaatcgctaatatattctagcggcggacgggtgagtaacgcgtgggtaacctgccctatacactgggataacatcgagaaatcggtgctaataccggataagctaacagtaaggcatcttatagttagaaaaactgaggtggtataggaggggcccgcgtctgattagctagttggtgtggtaaaagcataccaaggcgacgatcagtagccgacctgagagggtgatcggccacattggaactgagacacggtccaaactcctacgggaggcagcagtggggaatattgcacaatggggggaaccctgatgcagcaacgccgcgtgaaggaagaagtatttcggtatgtaaacttctatcgacagggaagaaaaaaatgacggtacctgaataagaagcaccggctaaatacgtgccagcagccgcggtaatacgtatggtgcaagcgttatccggatttactgggtgtaaagggtgagtaggcggttagataagtcatatgtgaaattctggggctcaactccagcgctgcataagaaactatttaactagagtacaggagaggtaagcggaattcctagtgtagcggtgaaatgcgtagatattaggaagaacaccggtggcgaaggcggcttactggactgaaactgacgctgagtcacgaaagcgtggggagcgaacaggattagataccctggtagtccacgctgtaaacgatgagtgctaggtgttgggaagaaattctcggtgccgcagcaaacgcaataagcactccacctggggagtacgaccgcaaggttgaaactcaaaggaattgacggggacccgcacaagcggtggagcatgtggtttaattcgaagcaacgcgaagaaccttacctaaacttgacataccattgacaggctacgtaaagtagctttccttcggggcaatggatacaggtggtgcatggttgtcgtcagctcgtgtcgtgagatgttgggttaagtcccgcaacgagcgcaacccctattcttagtagccagcactttgggtgggcactctaaggagactgccgtggataacacggaggaaggtggggatgacgtcaaatcatcatgccccttatgtttagggctacacacgtgctacaatggctataacaaagtgaagcgagacagtgatgtggagcaaagcacataaaagtagtcccagttcggattgtagtctgcaactcgactacatgaagttggaatcgctagtaatcgcgaatcagaatgtcgcggtgaatacgttcccgggtcttgtacacaccgcccgtcacaccatgggagttggaagcacccgaagcctgtgacctaaccgtaagggaggagcagtcgaaggtgaagccagtgactggggtgaagtcgtaacaaggtaacc

SEQ ID NO: 615 - DNA, 1487 bp, Clostridium putrefaciens
agagtttgatcctggctcaggacgaacgctggcggcgtgcttaacacatgcaagtcgagcgaagttattccttcgggaataacttagcggcggacgggtgagtaacacgtgggtaacctgcctcatagagggggatagccttccgaaaggaagattaataccccataacatagcattatcgcatgataaagttattaaaggagtaatccgctatgagatggacccgcggcgcattagctagttggtgaggtaacggctcaccaaggccacgatgcgtagccgacctgagagggtgatcggccacattgggactgagacacggcccagactcctacgggaggcagcagtggggaatattgcacaatgggcgaaagcctgatgcagcaacgccgcgtgagtgatgaaggccttcgggtcgtaaagctctgtcttcggggacgataatgacggtacccgaggaggaagccacggctaactacgtgccagcagccgcggtaatacgtaggtggcaagcgttgtccggatttactgggcgtaaagggagcgtaggcggatacttaagtgggatgtgaaatacccgggctcaacccgggtgctgcattccaaactgggtatctagagtgtgggagaggaaagtggaattcctagtgtagcggtgaaatgcgtagatattaggaagaacaccagtggcgaaggcgactttctggaccataactgacgctgaggctcgaaagcgtggggagcaaacaggattagataccctggtagtccacgccgtaaacgatggatactaggtgtgggggataccaatcctccgtgccgtcgttaacacactaagtatcccgcctggggagtacgatcgcaagattaaaactcaaaggaattgacgggggcccgcacaagcagcggagcatgtggtttaattcgaagcaacgcgaagaaccttacctagacttgacatctcctgaattacctgtaattagggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcctgggttaaccaggaggaaggtggggatgacgtcaaatcatcatgccccttatgtctagggctacacacgtgctacaatggcgagtacaacgagacgcaataccgcgaggtggagcaaaactcaaaaaactcgtcccagttcggattgtaggctgaaactcgcctacatgaagccggagttgctagtaatcgcgaatcagaatgtcgcggtgaatacgttcccgggccttgtacacaccgcccgtcacaccatgagagttggcaatacccgaagtccgtgtgctaacgcgtaagcgaggcagcggccgaaggtagggtcagcgattggggtgaagtcgtaacaaggtagccgtagaagaacctgc

SEQ ID NO: 616 - DNA, 1477 bp, Clostridium quinii
tttatcctgactcagacgaacgcttggcggcgtgcctaacacatgcaagtcgagcgaggagattccttcgggatgatcctagcggcggacgggtgagtaacacgtgggcaacctgcctcatagagaggaatagcctcccgaaagggagattaatacctcataacattgcagtttgcatgggacagcaattaaaggagcaatccgctatgagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaagctctgtcttcagggacgataatgacggtacctgaggaggaagccacggctaactacgtgccagcagccgcggtaatacgtaggtggcaagcgttgtccggatttactgggcgtaaagggagcgtaggcggacttttaagtgagatgtgaaatacccgggctcaacctgggtgctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggttgtcgatgacctctgtgccgccgtaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactcttaatcgaggaagtcttcagacagggaagacaggttgtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagaagcaagaccgcgaggtggagcaaaactcaaaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagttggtggtctaacctgaaggaggaagccacctaaggtagggtcagcgattggggtgaagtcgtaacaaggtagccgtagagaaccttg

SEQ ID NO: 617 - DNA, 1040 bp, Clostridium ramosum
  modified_base (7)..(9): a, c, t, g, unknown or other
  modified_base (12)..(12): a, c, t, g, unknown or other
  modified_base (18)..(18): a, c, t, g, unknown or other
  modified_base (20)..(20): a, c, t, g, unknown or other
  modified_base (22)..(22): a, c, t, g, unknown or other
  modified_base (27)..(27): a, c, t, g, unknown or other
  modified_base (31)..(31): a, c, t, g, unknown or other
  modified_base (43)..(43): a, c, t, g, unknown or other
gcgtgannngangttttngntntaaantctntataaaggaagnacggcggctacaggaaatggtagccgagtgacggtactttattagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagctatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaa

SEQ ID NO: 618 - DNA, 1505 bp, Clostridium rectum
gagagtttgatcctggctcaggatgaacgctgacagaatgcttaacacatgcaagtctagcttgatccttcgggtgatggtggcggacgggtgagtaacgcgtaaagaacttgccctgcagtctgggacaacatttggaaacgaatgctaataccggatattatgtgagtttcgcatgaaattcatatgaaagctatatgcgctgcaggagagctttgcgtcctattagctagttggtgaggtaacggctcaccaaggcgatgataggtagccggcctgagagggtgaacggccacaaggggactgagacacggcccttactcctacgggaggcagcagtggggaatattggacaatggaccaaaagtctgatccagcaattctgtgtgcacgatgaagttttcggaatgtaaagtgctttcagttgggacgaagtaagtgacggtaccaacagaagaagcgacggctaaatacgtgccagcagccgcggtaatacgtatgtgcaagcgttatccggatttattgggcgtaaagcgcgtcgtaggcggtttggtaagtctgatgtgaaaatgcggggctcaactccgtattgcgttggaaactgtccaaactagagtactggagaggtgggcggaactacaagtgtagaggtgaaattcgtagatatttgtaggaatgccgatggggaagccagcccactggacagatactgacgctaaagcgcgaaagcgtgggtagcaaacaggattagataccctggcctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctaagaaattagcagagatgcttttgtgccttcgggggaacttagtgacaggtggtgcatggctgtcgtcagctcgtgtcgtgagatgttgggttaagtcccgcaacgagcgcaacccctttcgtatgttgccatcattaagttgggcactcatgcgatactgcctgcgatcagcaggaggaaggtggggatgacgtcaagtcatcatgccccttatacgctgggctacacacgtgctacaatgggtagtacagagagtcgcaaacctgcgagggggagctaatctcagaaaactattctcagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtagcaggcctaaccgcaaggagggatgctccgagggtgtgattagcgattggggtgaagtcgtaacaaggtatccgtacgggaacgtgcggctggatcacctcctt

SEQ ID NO: 619 - DNA, 1326 bp, Clostridium saccharogumia
gagtttgatcctggctcaggatgaacgctggcggcgtgcctaatacatgcaagtcgaacgagtggcgaacgggtgagtaagacataagtaacctgccctttacagggggataactattggaaacgatagctaagaccgcatagtaaaactggtagaggatggacttatggcgcattagctggttggtgaggtaacggctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaggaaggtcttcggactgtaaacttctgttataaaggaagatgacggtactttatgaggaagccacggctaactacgtgccagcagccgcggtaatacgtaggtggcaagcgttatccggaattattgggcgtaaagagggagcaggcggcagcaagggtctgtggtgaaagactgaagcttaacttcagtaagccatagaaaccgggcagctagagtgcaggagaggatcgtggaattccatgtgtagcggtgaaatgcgtagatatatggaggaacaccagtggcgaaggcgacgatctggcctgactgacgctcagtcccgaaagcgtggggagcaaataggattagataccctagtagtccacgccgtaaacgatgagtactaagtgttgggatctcagtgctgcagttaacgcagtaagtactccgcctgagtagtacgttcgcaagaatgaaactcaaaggaattgacgggggcccgcacaagcggtggagcatgtggtttaattcgaagcaacgcgaagaaccttaccaggtcttgacatatacaggtggtgcatggttgtcgtcagctcgtgtcgtgagatgttgggttaagtcccgcaacgagcgcaacccttatcgttagttaccatcatggggactctagcgagactgccagtgacaagctggaggaaggcggggatgacgtcaaatcatcatgccccttatgacctgggctacacacgtgctacaatggatggcagagggaagcgaagccgcgaggtggagcgaaacccagccattctcagttcggatgtagtctgcaactcgactacagaagttggaatcgctagtaatcgcgaatcagcatgtcgcggtgaatacgttctcgggccttgtacacaccgcccgtcacaccatgagagttgataacacccgaagccggtgcctagggagctgtctaaggtgggattgatgattggggtgaagtcgtaacaagg

SEQ ID NO: 620 - DNA, 1519 bp, Clostridium saccharolyticum
agagttcgatcctggctcaggatgaacgctggcggcgtgcttaacacatgcaagtcgagcgaagcacttttaaggaagttttcggatggaattaaaagtgactgagcggcggacgggtgagtaacgcgtgggtaacctgcctcatacagggggataacagttggaaacgactgctaataccgcataagcacacagtgccgcatggtacggtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcactgcaagtctggagtgaaagcccggggctcaaccccgggactgctttggaaactgtggtgctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggtccgtaacggggccttcccttcggggcattccagacaggtggtgcatggttgtcgtcagctcgtgtcgtgagatgttgggttaagtcccgcaacgagcgcaacccttatccttagtagccagcagttcggctgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaaggtgcggctggatcacct

SEQ ID NO: 621 - DNA, 1519 bp, Clostridium sardiniense
tttaaattgagagtttgatcctggctcaggacgaacgctggcggcgtgcctaacacatgcaagtcgagcgatgaagtttccttcgggaaacggattagcggcggacgggtgagtaacacgtgggtaacctgcctcatagaggggaatagccttccgaaaggaagattaataccgcataacattgcagtttcgcatgaaacagcaattaaaggagcaatccgctatgagatggacccgcggcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttggggacgataatgacggtacccaaggaggaagccacggctaactacgtgccagcagccgcggtaatacgtaggtggcaagcgttgtccggatttactgggcgtaaagggagcgtaggcggatttttaagtgggatgtgaaatacccgggctcaacctgggtgctgcattccaaactgggaatctagagtgcaggaggggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggtttcgatacctctgtgccgccgctaacgcattaagtattccgcctggggagtacggtcgcaagatcaaaactcaaaggaattgacgggggcccgcacaagtagcggagcatgtggtttaattcgaagcaacgcgaagaaccttacctagacttgacatcttctgcattacccttaatcggggaagtcctttcggggacagaatgacaggtggtgcatggttgtcgtcagctcgtgtcgtgagatgttgggttaagtcccgcaacgagcgcaacccctattgttagttgctaccattaagttgagcactctagcgagactgcccgggttaaccgggaggaaggtggggatgacgtcaaatcatcatgccccttatgtctagggctacacacgtgctacaatggcaagtacagagagatgcaataccgtgaggtggagctaaacttcaaaacttgtctcagttcggattgtaggctgaaactcgcctacatgaagctggagttactagtaatcgcgaatcagcatgtcgcggtgaatacgttcccgggccttgtacacaccgcccgtcacaccatgagagttggcaatacccaaagttcgtgagctaacgcgtaagcgaggcagcgacctaaggtagggtcagcgattggggtgaagtcgtaacaaggtagccgtaggagaacctgcggctggatcacctcctttct

SEQ ID NO: 622 - DNA, 1470 bp, Clostridium sartagoforme
ggctcaggacgaacgctggcggcgtgcctaacacatgcaagtcgagcgaggagattcccttcggggatgaacctagcggcggacgggtgagtaacacgtgggcaacctgccttatagaggggaatagccttccgaaaggaagattaataccgcataacattacattttcgcatgaagaagtaattaaaggagtaatccgctataagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggtcttcggatcgtaaagctctgtcttcagggacgataatgacggtacctgaggaggaagccacggctaactacgtgccagcagccgcggtaatacgtaggtggcgagcgttgtccggatttactgggcgtaaagggagcgtaggcggatttttaagtgagatgtgaaatacccgggctcaacttgggtgctgcatttcaaactggaagtctagagtgcaggagaggagagtggaattcctagtgtagcggtgaaatgcgtagagattaggaggaacaccagtggcgaaggcgactctctggactgtaactgacgctgaggctcgaaagcgtggggagcaaacaggattagataccctggtagtccacgccgtaaacgatgaatactaggtgtaggggttgtcatgacctctgtgccgccgcaaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactcttaatcgaggaagtcccttcggggacaggaagacaggtggtgcatggttgtcgtcagctcgtgtcgtgagatgttgggttaagtcccgcaacgagcgcaacccttattgttagttgctaccattaagttgagcactctagcaagactgcccgggttaaccgggaggaaggtggggatgacgtcaaatcatcatgccccttatgtctagggctacacacgtgctacaatggcaagtacaaaaagatgcaataccgcaaggtggagctaaacttaaaaacttgtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacccgtaagggaggcagcgacctaaggtagggtcagcgaatggggtgaagtcgtaacaaggtagccgtagga

SEQ ID NO: 623 - DNA, 1529 bp, Clostridium scindens
gagagtttgatcctggctcaggatgaacgctggcggcgtgcctaacacatgcaagtcgaacgaagcgcctggccccgacttcttcggaacgaggagccttgcgactgagtggcggacgggtgagtaacgcgtgggcaacctgccttgcactgggggataacagccagaaatggctgctaataccgcataagaccgaagcgccgcatggcgcggcggccaaagccccggcggtgcaagatgggcccgcgtctgattaggtagttggcggggtaacggcccaccaagccgacgatcagtagccgacctgagagggtgaccggccacattgggactgagacacggcccagactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcgatgcaagccagatgtgaaagcccggggctcaaccccgggactgcatttggaactgcgtggctggagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggtggcaaggccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattttggatgggcactctggagagactgccagggagaacctggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagttggaatcgctagtaatcgcgaatcagaatgtcgcggtgaatacgttcccgggtcttgtacacaccgcccgtcacaccatgggagtcagtaacgcccgaagccggtgacccaacccgtaagggagggagccgtcgaaggtgggaccgataactggggtgaagtcgtaacaaggtagccgtatcggaaggtgcggctggatcacctccttc

SEQ ID NO: 624 - DNA, 1507 bp, Clostridium septicum
agagtttgatcatggctcaggacgaacgctggcggcgtgcctaacacatgcaagtcgagcgaggggagtttcttcggaaacaaacctagcggcggacgggtgagtaacacgtgggcaacctgccttgtagaggggaatagcctcccgaaagggagattaataccgcataacattgcagcttcgcatggagcagcaattaaaggagtaatccgctacaagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtcttcagggacgataatgacggtacctgaggaggaagccacggctaactacgtgccagcagccgcggtaatacgtaggtggcgagcgttgtccggatttactgggcgtaaagggagcgtaggcggacttttaagtgagatgtgaaatacccgggctcaacctgggggctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatggatactaggtgtgggaggtatcaactccttccgtgccgccgttaacacattaagtatcccgcctggggagtacggtcgcaagattaaaactcaaaggaattgacgggggcccgcacaagcagcggagcatgtggtttaattcgaagcaacgcgaagaaccttacctagacttgacatctcctgcattactcttaatcgaggaagtcccttcggggacaggatgacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaacgagatgcaataccgygaggtggagctaaactataaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctt

SEQ ID NO: 625 - DNA, 1364 bp, Clostridium sordellii
  modified_base (12)..(12): a, c, t, g, unknown or other
gtcgagcgatcncttcggagagagcggcggacgggtgagtaacgcgtgggtaacctgccctgtacacacggataacataccgaaaggtatactaatacgggataacatatgaaagtcgcatggcttttgtatcaaagctccggcggtacaggatggacccgcgtctgattagctagttggtaaggtaatggcttaccaaggcaacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggtggttttttaagtcagaagtgaaaggctacggctcaaccgtagtaagcttttgaaactagagaacttgagtgcaggagaggagagtagaattcctagtgtagcggtgaaatgcgtagatattaggaggaataccagtagcgaaggcggctctctggactgtaactgacactgaggcacgaaagcgtggggagcaaacaggattagataccctggtagtccacgccgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccactgacctctccctaatcggagatttcccttcggggacagtggtgacaggtggagcatggaagtcgtcagctcgtgtcgtgagatgttgggattagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaagccgcgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatggaagttgggggcgcccgaagccggttagctaaccttttaggaagcggccg

SEQ ID NO: 626 - DNA, 1378 bp, Clostridium sp.
  7_2_43FAA
tcgagcgagaggagttccttcgggaacaaatctagcggcggacgggtgagtaacacgtgggcaacctgccttgtagaggggaatagccttccgaaaggaagattaataccgcataatattacattttcgcatgaagaagtaattaaaggagcaatccgctacaagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggtcttcggatcgtaaagctctgtcttcagggacgataatgacggtacctgaggaggaagccacggctaactacgtgccagcagccgcggtaatacgtaggtggcgagcgttgtccggatttactgggcgtaaagggagcgtaggcggatttttaagtgagatgtgaaatacccgggctcaacttgggtgctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggttgtcatgacctctgtgccgccgcaaacgcattaagtattccgcctggggagtacggtcgcaagattaaaactcaaaggaattgacgggggcccgcacaagcagcggaccatgtggtttaattcgaagcaacgcgaagaaccttacctagacttgacatctcctgcattactcttaatcgaggaagtcctttcggggacaggatgacaggtgctgcatgttaaactggaagtctagagtgcaggagtggggtgaggacctccaagtagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagatgcgataccgcgaggtggagctaaactataaaacttgtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacccgtaagggaggcagcgac

SEQ ID NO: 627 - DNA, 1390 bp, Clostridium sp.
  D5
  modified_base (1252)..(1252): a, c, t, g, unknown or other
  modified_base (1302)..(1302): a, c, t, g, unknown or other
tcgagcgaagcgctttacttagatttcttcggattgaagagtgttgcgactgagcggcggacgggtgagtaacgcgtgggtaacctgcctcatacagggggataacagttagaaatgactgctaataccgcataagaccacagtaccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgcatactaggtgtcgggtggcaaagccattcggtgccgcagcaaacgcaataagtatgccacctggggagtacgttcgcaagaatgaaactcaaaggaattgacggggacccgcacaagcggtggagcatgtggtttatttcaaagcaacgcgaagaatcttacctgctcttgacatccccctgaccggcgcgtaatggtgcctttccttcgggacaggggagacaggtggtgcatggttgtcgtcagctcgtgtcgtgagatgttgggttaagtcccgcaacgagcgcaacccttatctttagtagccagcggttcggccgggcactctagagagactgccagggataacctggaggaaggtggggatgacgtcaaatcatcatgccccttatgagcagggttacacacgtgctacaatggcgtaaacaaagggaggcaatcccgcgaggttgagcaaatcccaaaaataacgtttcacttcggatcgtagtgtgcaactngattacacgaagctggcattcatagtaatcgggaatcagaatgtcgcggngaatacgttcccgggtcttgtacacaccgcccgtcacaccatgggagttggtaacgcccgaagtcagtgacccaaccgtaaggaggga

SEQ ID NO: 628 - DNA, 1381 bp, Clostridium sp.
  HGF2
  modified_base (15)..(15): a, c, t, g, unknown or other
tcgaacgaagtttcnaggaagcttgcttccaaagagacttagtggcgaacgggtgagtaacacgtaggtaacctgcccatgtgtccgggataactgctggaaacggtagctaaaaccggataggtatacggagcgcatgctctgtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaaaaccttaccaggccttgacatggaaaccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaagaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgt

SEQ ID NO: 629 - DNA, 1274 bp, Clostridium sp.
  HPB-46
agtcgagcgggaaacttcggtttccagcggcggacgggtgagtaacacgtgggcaacctgcctcacaatgagggatagccttccgaaaggaagattaatacctcataacacaagagaaacgcatgtttctcttgccaaagaatttcgttgtgagatgggcccgcggcgcattagcttgttggtgaggtaacggctcaccaaggctgcgatgcgtagccgacctgagagggtgatcggccacattggaactgagacacggtccagactcctacgggaggcagcagtggggaatattgcacaatggaggaaactctgatgcagcaacgccgcgtgagtgatgaaggtcttcggattgtaaagctctgtcttctgggacgataatgacggcaccagaggaggaagccacggctaactacgtgccagcagccgcggtaatacgtaggtggcaagcgttgtccggatttactgggcgtaaaggatgtgtaggcggatatttaagtgagatgtgaaatccccaggctcaacttgggggctgcatttcaaactggatatctagagtgcaggagaggaaagcggaattcctagtgtagcggtgaaatgcgtagagattaggaagaacatcagtggcgaaggcggctttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctggggagtacggtcgcaagattaaaactcaaaggaattgacgggggcccgcacaagcagcggagcatgtggtttaattcgaagcaacgcgaagaaccttacccagacttgacatctcctgaattaatcgtaattgatgaaatcccttcggggacaggaagacaggtggtgcatggttgtcgtcagctcgtgtcgtgagatgttgggttaagtcccgcaacgagcgcaacccttatcattagttgctaacattaagttgagcactctagtgagactgcccgggttaaccgggaggaaggtggggatgacgtcaaatcatcatgccccttatgtctggggctacacacgtgctacaatggtgggaacaaagagatgcaataccgcaaggtggagccaaacttcaagacccatcccagttcggattgtaggctgaaactcgcctacatgaagctggagtgtagtaatcgcgaatcagagtgtagcggtgaa

SEQ ID NO: 630 - DNA, 1358 bp, Clostridium sp.
  JC122
cgatgaagctccttcgggagtgaattagcggcggacgggtgagtaacacgtgggtaacctgcctcatagaggggaatagccttccgaaagggagattaataccgcataacatagcactaccgcatggtagagttatcaaaggagcaatccgctatgagatggacccgcggcgcattagctagttggtgaggtaacggctcaccaaggcgacgatgcgtagccgacctgagagggtgatcggccacattggaactgagacacggtccagactcctacgggaggcagcagtggggaatattgcgcaatgggggaaaccctgacgcagcaacgccgcgtgagtgaagaaggccttagggttgtaaagctctgtcatatgggaagataatgacggtaccataagaggaagccacggctaactacgtgccagcagccgcggtaatacgtaggtggcgagcgttgtccggatttactgggcgtaaaggatgcgtaggcggatatttaagtgggatgtgaaatccccgagcttaactcgggggctgcattccaaactggatatctagagtgtcggaggggaaagtggaattcctagtgtagcggtgaaatgcgtagagattaggaagaacaccagtggcgaaggcgactttctggacgataactgacgctgaggcatgaaagcgtggggagcaaacaggattagataccctggtagtccacgccgtaaacgatgaatactaggtgtaggaggtatcgactccttctgtgccgcagttaacacattaagtattccgcctggggagtacgatcgcaagattaaaactcaaaggaattgacgggggcccgcacaagcagcggagcatgtggtttaattcgaagcaacgcgaagaaccttacctagacttgacatctcctgcattactcttaacagaggaagtccttcgggacaggatgacaggtggtgcatggttgtcgtcagctcgtgtcgtgagatgttgggttaagtcccgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggtaggtacaacaagatgcaataccgtgaggtggagctaaactcaaaaacctatcccagttcggattgtaggctgaaactcgcctacatgaagccggagttgctagtaatcgcgaatcagcatgtcgcggtgaatacgttcccgggccttgtacacaccgcccgtcacaccatgagagccgataacacccgaagtccgtgaggtaaccgtaagg

SEQ ID NO: 631 - DNA, 1345 bp, Clostridium sp.
  L2-50
cttgcactgatccgatcgagtggcggacgggtgagtaacgcgtgggtaacctgcctcatacaggggaataacagttggaaacggctgctaaaaccgcataagcgcacagtatcgcatgatacagtgtgaaaaactccggtggtatgagatggacccgcgtctgattagctagttggtgaggtaacggcccaccaaggcaacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggtgagacaagtctgaagtgaaaatccggggcttaaccccggaactgctttggaaactgcctgactagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgtcggggcccaaagggcttcggtgccgcagggacgcaataagtattccacctggggagtacgttcgcaagaatgaaactcaaaggaattgacggggacccgcacaagcggtggagcatgtggtttaattcgaagcaacgcgaagaaccttaccaagtcttgacatcctgctgaccgttccttaaccggaattttccttcgggacagcagagacaggtggggcatggttgtcgtcagctcgtgtcgtgagatgttgggttaagtcccgcaacgagcgcaacccctatttccagtagccagcagtcagatgggcactctggagagactgccggggataacccggaggaaggtggggatgacgtcaaatcatcatgccccttatgatttgggctacacacgtgctacaatggcagttacaaagagaagcgaaactgtgaagtggagcaaacctcaaaaaggctgtctcagttcggattgtagtctgcaactcgactacatgaagctggaatcgctagtaatcgcagatcagaatgctgcggtgaatacgttcccgggtcttgtacacaccgcccgtcacaccatgggagtcggaaacgcccgaagtcagtgacccaaccgc

SEQ ID NO: 632 - DNA, 1464 bp, Clostridium sp.
  LMG 16094
gacgaacgctggcggcgtgcctaacacatgcaagtcgagcgaggggagttcttcggaacaaacctagcggcggacgggtgagtaacacgtgggcaacctgcctcaaagaggggaatagcctcccgaaagggagattaataccgcataaagttattttttcgcatgaagagataaccaaaggagcaatccgctttgagatgggcccgcggcgcattagctagttggtgaggtaacggctcaccaaggcgacgatgcgtagccgacctgagagggtgatcggccacattggaactgagacacggtccagactcctacgggaggcagcagtggggaatattgcgcaatgggggaaaccctgacgcagcaacgccgcgtgagcgatgaaggtcttcggattgtaaagctctgtcttttgggacgataatgacggtaccaaaggaggaagccacggctaactacgtgccagcagccgcggtaatacgtaggtggcaagcgttgtccggatttactgggcgtaaagagtatgtaggcggacatttaagtcagatgtgaaattcccgggcttaacctgggagctgcatttgatactgggtgtctagagtgcaggagaggaaagtggaattcctagtgtagcggtgaaatgcgtagagattaggaagaacaccagtggcgaaggcgactttctggactgtaactgacgctgagatacgaaagcgtggggagcaaacaggattagataccctggtagtccacgccgtaaacgatgaatactaggtgtcggagggtaccaccttcggtgccgcagcaaacgcaataagtattccgcctggggagtacggtcgcaagattaaaactcaaaggaattgacggggacccgcacaagcagcggagcatgtggtttaattcgaagcaacgcgaagaaccttacctagacttgacatctcctgaattactcgtaacagaggaagcccttcggggcaggaagacaggtggtgcatggttgtcgtcagctcgtgtcgtgagatgttgggttaagtcccgcaacgagcgcaacccctattgttagttgctaccattaagttgagcactctagcaagactgcctgggttaaccaggaggaaggtggggatgacgtcaaatcatcatgscccttatgtctagggctacacacgtgctacaatggtcggtacaaaaagatgcaaacccgtgagggggagctaaacttaaaaaccgatcccagttcggattgtaggctgaaactcgcctacatgaagttggagttgctagtaatcgcgaatcagcatgtcgcggtgaatacgttcccgggtcttgtacacaccgcccgtcacaccatgagagccggtaacacccgaagcccgtgaggtaaccgwaaggagccagcggtcgaaggtgggattggtgattggggtgaagtcgtaacaaggtagccgtaggagaacctgc

SEQ ID NO: 633 - DNA, 1045 bp, Clostridium sp.
  M62/1
  modified_base (967)..(968): a, c, t, g, unknown or other
  modified_base (977)..(977): a, c, t, g, unknown or other
  modified_base (984)..(985): a, c, t, g, unknown or other
  modified_base (1010)..(1010): a, c, t, g, unknown or other
  modified_base (1014)..(1015): a, c, t, g, unknown or other
aacgaagcggtttagcggaagttttcggatggaagttaaactgactgagtggcggacgggtgagtaacgcgtgggtaacctgcctcacacagggggacaacagctagaaatggctgctaataccgcataagcgcacagcttcgcatgaagcagtgtgaaaaactccggtggtgtgagatggacccgcgtctgattagctggttggtgaggtaacggctcaccaaggcgacgatcagtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagagaatgacggtacctgactaagaagccccggctaactacgtgccagcagccgcggtaatacgtagggggcaagcgttatccggatttactgggtgtaaagggagcgtagacggcttagcaagtctgaagtgaaagcccggggctcaaccccgggactgctttggaaactgttaagctggagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttggtgggcaaagcccatcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtccttctcttcggagcagtggnnacaggtggngcatggnngtcgtcagctcgtgtcgtgagatgntggnnaagtcccgcaacgagcgcaacccttatcct

SEQ ID NO: 634 - DNA, 935 bp, Clostridium sp.
  MLG055
  modified_base (776)..(776): a, c, t, g, unknown or other
  modified_base (890)..(891): a, c, t, g, unknown or other
  modified_base (893)..(893): a, c, t, g, unknown or other
  modified_base (895)..(895): a, c, t, g, unknown or other
  modified_base (910)..(912): a, c, t, g, unknown or other
acttagtggcgaacgggtgagtaacacgtagataacctgcctgtatgaccgggataacagttggaaacgactgctaataccggataggcagagaggaggcatctcttctctgttaaagttgggatacaacgcaaacagatggatctgcggtgcattagctagttggtgaggtaacggcccaccaaggcgatgatgcatagccggcctgagagggcgaacggccacattgggactgagacacggcccaaactcctacgggaggcagcagtagggaattttcggcaatgggggaaaccctgaccgagcaatgccgcgtgagtgaagacggccttcgggttgtaaagctctgttgtaagggaagaacggcatagagagggaatgctctatgagtgacggtaccttaccagaaagccacggctaactacgtgccagcagccgcggtaatacgtaggtggcaagcgttatccggaattattgggcgtaaagggtgcgtaggcggcgagataagtctgaggtaaaagcccgtggctcaaccacggtaagccttggaaactgtctggctggagtgcaggagaggacaatggaattccatgtgtagcggtaaaatgcgtagatatatggaggaacaccagtggcgaaggcggttgtctggcctgtaactgacgctgaagcacgaaagcgtggggagcaaataggattagataccctagtagtccacgccgtaaacgatgagaactaagtgttggggaaactcagtgctgcagttaacgcaatangttctccgcctgggggagtatgcacgcaagtgtgaaactcaaaggaattgacgggggcccgcacaagcggtggagtatgtggtttaattcgacgcaacgcgaagaaccttaccnngncntgacatggtatcaannncctagagatagggagatagttat

SEQ ID NO: 635 - DNA, 1364 bp, Clostridium sp.
  MT4 E
catgcacgtcgagcgactcttctggagagagcggcggacgggagagcacgcgagggtacctgccctgtcacacggataacactaccgaaaggtatactaatacggggactaacatactgaaagtcgcatggcttttgtatcaaagctccggcggtacaggatggacccgcgtctgattagctagttggtaaggtaatggcttaccaaggcaacgatcagtagccgaccttgagaagggtgaatcgggccactactggaaatgaagacacgggtccaagactcctactggggaggcagcagtggggaatattgcacaatgggcgaaagcctgatgcagcaacgccgcgtgagcggatgaaggccttcgggtcgtaaagctctgtcctcaaggaagataatgacgggtactttgaggaggaagccccgggctaactacgtgccagcagccgcgggtaatacggtagggggctagcgttatccgggaaattactgggcgtaaagggtgcggtaaggtggtttttttaagtcagaagtgaaaggctacggctcaaccggtagtaagctttttgaaactagagaactttgagtgcaggagaggagagtagaattcctagtgtagcggtgaaatgcgtaaatttaggaggaataccagtagcgaaggcggcttctctggacttgtaactgacactgaggccgaaagcgggggagcaacaggattagatccctggtagtcccgccgtaaacgatgagtactagggtgtcgggggttacccccctcggtgccgcagctaacgcattaagtactccgcctgggaagtacgctcgcaagagtaaactcaaaggaattgaccgggacccgcacaaagtagcggagcatgtggtttaattcgaagcaaacgcgaagaaccttacctaagcttgacatcccactgacctctccctaaatcggagatttcccttcggggccagtggtgacaggtggtgcatggttgtcgtcagctcgtgtcgtgagatgttgggttaagtcccgcaacgagcgcaacccttgcctttagttgccagcattaagttgggcactctagagggactgccgaggataactcggaggaaggtggggatgacgtcaaatcatcatgccccttatgcttagggctacaccaccgtgctacaatgggtggtacagagggttgccaagccgcgaaggtggagctaatcccttaaagccattctcagttcggattgtaggctgaaactcgcctacatgaagctggagttactagtaatcgcaatcagaatgctgcggtgatgcgttcccgggtcttgtacacaccgcccgtcacaccattggaagttggggcgccaga

SEQ ID NO: 636 - DNA, 1205 bp, Clostridium sp.
  NMBHI-1
aaagggagattaataccgcataatgtatgagaatcgcatgatttttgtaccaaaggagcaatccgctatgagatggacccgcggcgcattagctagttggtgaggtaaaggctcaccaaggcgacgatgcgtagccgacctgagagggtgatcggccacattggaactgagacacggtccagactcctacgggaggcagcagtggggaatattgcgcaatgggggaaaccctgacgcagcaacgccgcgtgaatgaagaaggccttagggttgtaaagttctgtcatatgggaagataatgacggtaccatatgaggaagccacggctaactacgtgccagcagccgcggtaatacgtaggtggcaagcgttgtccggatttactgggcgtaaaggatgcgtaggcggacatttaagtcagatgtgaaatacccgggctcaacttgggtgctgcatttgaaactgggtgtctagagtgcaggagaggaaagcggaattcctagtgtagcggtgaaatgcgtagagattaggaagaacaccagtggcgaaggcggctttctggactgtaactgacgctgaggcatgaaagcgtggggagcaaacaggattagataccctggtagtccacgccgtaaacgatgaatactaggtgtaggaggtatcgaccccttctgtgccgcagttaacacaataagtattccgcctggggagtacgatcgcaagattaaaactcaaaggaattgacgggggcccgcacaagcagcggagcatgtggtttaattcgaagcaacgcgaagaaccttacctagacttgacatcccctgaattacctgtaatgagggaagcccttcggggcagggagacaggtggtgcatggttgtcgtcagctcgtgtcgtgagatgttgggttaagtcccgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggttggtacaataagatgcaataccgcgaggtggagctaaacttataaaaccaatcccagttcggattgtaggctgaaactcgcctacatgaagccgggagttgctagtaatcgcgaatcagcatgtcgcggtgaatacgttcccgg

SEQ ID NO: 637 - DNA, 1389 bp, Clostridium sp.
  NML 04A032
tcgacggggtgcctatgatagaggattcgtccaattgattaggctacctagtggcggacgggtgagtaacgcgtgagtaacctgccttggagtggggaataacagtccgaaaggactgctaataccgcatgatgcagcgaggtcgcatggccttgctgccaaagatttatcgctctgagatggactcgcgtctgattagctggttggcggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctctcgggttgtaaacttcttttatcagggacgaaagaaatgacggtacctgatgaataagccacggctaactacgtgccagcagccgcggtaatacgtaggtggcaagcgttatccggatttactgggtgtaaagggcgtgtaggcgggaaagcaagtcaggcgtgaaaactatgggctcaacccatagcctgcgtttgaaactgtttttcttgagtgtcggagaggcaatcggaattccgtgtgtagcggtgaaatgcgtagatatacggaggaacaccagtggcgaaggcggattgctggacgataactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcgtactaacgaagcagacatgcattagatgcccttcggggaaagtatagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggccacacacgtactacaatggcggtcaacagagggaggcaataccgcgaggtggagcaaatccctaaaagccgtcccagttcggattgcaggctgaaacccgcctgcatgaagttggaatcgctagtaatcgcggatcagcatgccgcggtgaatacgttcccgggccttgtacacaccgcccgtcacaccatgagagtcgggaacacccgaagtccgtagcctaaccgcaaggggggcgc

SEQ ID NO: 638 - DNA, 1031 bp, Clostridium sp.
  SS2/1
  modified_base (16)..(16): a, c, t, g, unknown or other
  modified_base (26)..(27): a, c, t, g, unknown or other
cgtgagtgaagaagtnttctcggtanntaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactagagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacttttccttcgggacaggagtgacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggag

SEQ ID NO: 639 - DNA, 1375 bp, Clostridium sp.
  SY8519
tttatggagtttgatcctggctcaggatgaacgctggcggcgtgcctaacacatgcaagtcgaacgagtggcggacgggtgagtaacgcgtggataacctgcctcaaacagggggataacagccggaaacggctgctaataccgcataagaaaaagtggtttgagatggatccgcgtctgattagttagttggcggggtaacggcccaccaaggcgacgatcagtagccggcctgagagggtgaacggccacattgggactgagacacggcccagactcctacgggaggcagcagtggggaatattgcacaatgggggaaaccctgatgcagcaacgccgcgtgagcgaagaagtatttcggtatgtaaagctctatcagcagggaagatgacggtacctgactaagaagctccggctaaatacgtgccagcagccgcggtaatacgtatggagcaagcgttatccggatttactgggtgtaaagggagcgcaggcggtggcgcaagtctgatgtgaaaacccggggcccaaccccgggactgcattggaaactgcgtgacttgagtgtcggaggggtaagtggaattcctagtgtagcggtgaaatgcgtagatattaggaggaacaccagtggcgaaggcggcttactggacgaactgacgctgaggctcgaaagcgtggggagcaaacaggattagataccctggtagtccacgccgtaaacgatgaatactaggtgttggcatgtcagtgccgcagcaaacgcattaagtattccacctggggagtacgttcgcaagaatgaaactcaaaggaattgacggggacccgcacaagcggtggagcatgtggtttaattcgaagcaacgcgaagaaccttaccaggccttgacatcgacaggtggtgcatggttgtcgtcagctcgtgtcgtgagatgttgggttaagtcccgcaacgagcgcaacccttgtgtatagtagccagcggccgggcactctatacagactgccagggacaacctggaggaaggcggggatgacgtcaaatcatcatgccccttatggcctgggcgacacacgtgctacaatggcgtacagagggaggcaaagccgcgaggtggagcgaatcccaaaacgtctcagttcggatgcaggctgcaacccgcctgcagaagctggaatcgctagtaatcgcagatcagcatgctgcggtgaatacgttcccgggtcttgtacacaccgcccgtcacaccatgggagtcggaaatgcccgaagccggtacccagggagccgtcgaaggcaggtctgataactggggtgaagtcgtaacaaggtagccgtatcggaaggtgcggctggatcacctcctttct

SEQ ID NO: 640 - DNA, 1267 bp, Clostridium sp.
  TM-40
acatgcaagtcggacgagtggcgaacgggtgagtaagacataagcaacctgcccctgtgagggggataactgctggaaacggcagctaagaccgcatagtaaattagcacagggatgggcttatgacgcattagccagctggtgaggtaacggctcaccagggcgacgatgcgtagccggcctgagagggtggacggccacactgggactgagacacggcccagactcctacgggaggcagcagtagggaattttcggcaatgggcgaaagcctgaccgagcaacgccgcgtgaaggaagaagtcattcgtgatgtaaacttctgttatgaaggaagatgacggtacttcatgaggaagccacggctaactacgtgccagcagccgcggtaatacgtaggtggcgagcgttatccggaatcattgggcgtaaagagggagcaggcggcagtgcaggtctgcggtgaaagaccggagctaaacttcggtaagccgtggaaaccgcacagctagagagcatcagaggatcgcggaattccatgtgtagcggtgaaatgcgtagatatatggaggaacaccagtggcgaaggcggcggtctggggtggctgacgctcagtcccgaaagcgtggggagcaaataggattagataccctagtagtccacgccgtaaacgatgagtgctaagtgttggggcctcagtgctggagttaacgcaataagcactccgcctgagtagtacgttcgcaagaatgaaactcaaaggaattgacgggggcccgcacaagcggtggagcatgtggtttaattcgaagcaacgcgaagaaccttaccaggtcttgacatgcacaggtggtgcatggttgtcgtcagctcgtgtcgtgagatgttgggttaagtcccgcaacgagcgcaacccctgttgccagttgccagcatggggactctggcgagactgcctctgcaaggaggaggaaggcggggatgacgtcaaatcatcatgccccttatgacctgggctacacacgtgctacaatggacggcagagggaggcgaagccgcgaggtggagcgaaacccagccgttcacagttcggatgcagtctgcaactcgactgcagaagctggaatcgctagtaatcgcgaatcagcatgtcgcggtgaatacgttctcgggccttgtacacaccgcccgtcacaccatgagagttggtaacacccgaagccggtgcccagggagctgtctaaggtgggactgatgattggggtg

SEQ ID NO: 641 - DNA, 1320 bp, Clostridium sp.
  YIT 12069
gacgaacgctggcggcgtgcctaacacatgcaagtcgaacgagtggcggacgggtgagtaacgcgtgagcaacctgcctcaaagagggggataacgtctggaaacggacgctaataccgcatgaccaaagccgctttgagatgggctcgcgtctgattagctagttggtggggtaaaggcctaccaaggcgacgatcagtagccggactgagaggttgaacggccacattgggactgagacacggcccagactcctacgggaggcagcagtgggggatattgcacaatgggggaaaccctgatgcagcaacgccgcgtgaaggaagacggttttcggattgtaaacttctgttcttagtgacgatgacggtagctaaggagaaagctccggctaactacgtgccagcagccgcggtaatacgtagggagcgagcgttgtccggaattactgggtgtaaagggagcgtaggcgggagatcaagtcagatgtgaaaactatgggctcaacccataacctgcatttgaaactgttcttcttgagtgaagtagaggcaggcggaattccgagtgtagcggtgaaatgcgtagatattcggaggaacaccagtggcgaaggcggcctgctgggcttactgacgctgaggctcgaaagcatggggagcaaacaggattagataccctggtagtccatgccgtaaacgatgattactaggtgtggggtattccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcgacaggtggtgcatggttgtcgtcagctcgtgtcgtgagatgttgggttaagtcccgcaacgagcgcaacccttgtcattagttgctacagcactctaatgagactgccgttgacaaaacggaggaaggtggggacgacgtcaaatcatcatgccccttatgacctgggctacacacgtactacaatggccgtcagagggaagcaatactgtgaagtggagcaaacccctacggtcccagttcagatgcaggctgcaacccgcctgcagaagtcggaattgctagtaatcgcggatcagcatgccgcggtgaatacgttcccgggccttgtacacaccgcccgtcacaccatgggagccggtaatacccgaagtcggtgtctaggacgccgccgaaggtaggattggcgactggggtgaagtcgtaacaaggtagccgtatcggaagg

SEQ ID NO: 642 - DNA, 1319 bp, Clostridium sp.
  YIT 12070
gacgaacgctgtcggcgcgcctaacacatgcaagtcgaacgagtggcggacgggtgagtaacgcgtgagtaacctgcctttcagagggggataacgtctggaaacggacgctaataccgcataaccaaagccgctgaaagatggactcgcgtccaattagctagttggtgaggtaacggcccaccaaggcgacgattggtagccggactgagaggttgaacggccacattgggactgagacacggcccagactcctacgggaggcagcagtggggaatattgcacaatgggggaaaccctgatgcagcgacgccgagtgagggaagaaggttttcggattgtaaacctctgtccttggtgaagatgacggtaaccaaggaggaagctacggctaactacgtgccagcagccgcggtaatacgtaggtagcgagcgttgtccggaattactgggtgtaaagggagcgtaggcgggattgcaagttgaatgttaaatctatgggctcaacccatagccgcgttcaaaactgcagttcttgagtgaagtagaggcaggcggaattcctagtgtagcggtgaaatgcgtaaatattaggaggaacaccagtggcgaaggcggcctgctgggcttactgacgctgaggctcgaaagcgtgggtagcaaacaggattagataccctggtagtccacgctgtaaacgatgattactaggtgtgggggcttccgtgccggagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatcgacaggtggtgcatggttgtcgtcagctcgtgtcgtgagatgttgggttaagtcccgcaacgagcgcaacccttacgtttagttgctacagcactctagacggactgccgttgacaaaacggaggaaggtggggatgacgtcaaatcatcatgccccttatgacctgggctacacacgtactacaatggctatcagagggaagcaagatggtgacatggagcaaacccctatagtctcagttcggatgcaggctgcaacccgcctgcagaagccggaattgctagtaatcgcggatcagcatgccgcggtgaatacgttcccgggccttgtacacaccgcccgtcacaccatgagagttggcaacacccgaagccgatgtctaggacgtcgtcgaaggtggggttgatgattggggtgaagtcgtaacaaggtagccgtatcggaagg

SEQ ID NO: 643 - DNA, 1522 bp, Clostridium sphenoides
  modified_base (1)..(7): a, c, t, g, unknown or other
  modified_base (1455)..(1455): a, c, t, g, unknown or other
  modified_base (1513)..(1514): a, c, t, g, unknown or other
nnnnnnngagagtttgatcctggctcaggacgaacgctggcggcgtgcttaacacatgcaagtcgagcgaagcgattcaaatgaagtttcggacggattttgaattgacttagcggcggacgggtgagtaacgcgtgggtaacctgcctcatacagggggataacagtcggaaacgactgctaataccgcataacacacagtgccgcatggtacggtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcactgcaagtctggagtgaaagcccggggctcaaccccggactgctttggaaactgtggtgctagagtgcaggagaggtaagtggaattcctagtgtagcggtgaaatgcgtagatattaggaggaacaccagtggcgaaggcggcttactggactgtaactgacgttcgaggctcgaaagcgtggggagcaaacaggattagataccctggtagtccacgccgtaaacgatgaatactaggtgttggggagcaaagctcttcggtgccgccggtaacgcaataagtattccacctggggagtacgttcgcaagaatgaaactcaaaggaattgacggggaccgcacaagcggtggagcatgtggtttaattcgaagcaacgcgaagaccttaccaagtcttgacatcggaatgaccgggatgtaacgatcccttcccttcggggcatccagacaggtggtgcatggttgtcgtcagctcgtgtcgtgagatgttgggttaagtcccgcaacgagcgcaacccttatccttagtagccagcaagtcaagctgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgtaaggagggagctgccgangggactgataactggggtgaagtcgtaacaaggtagccgtatcggaaggtgcggctgnntcacctcc

SEQ ID NO: 644 - DNA, 1367 bp, Clostridium spiroforme
  modified_base (41)..(42): a, c, t, g, unknown or other
agcaatgctcgagtggcgaacgggtgagtaatacataagtnncctgccctagacagggggataactgctggaaacggcagctaagaccgcataggtatggacactgcatggtgaccatattaaaagtgccaaggcactggtagaggatggacttatggcgcattagctggttggtgaggtaacggctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaagaaggaattcgttctgtaaacttctgttataaaggaagaacggcggatatagggaatgatatccgagtgacggtactttatgagaaagccacggctaactacgtgccagcagccgcggtaatacgtaggtggcgagcgttatccggaattattgggcgtaaagagggagcaggcggcggcagaggtctgtggtgaaagactgaagcttaacttcagtaagccatagaaaccgggctgctagagtgcaggagaggatcgtggaattccatgtgtagcggtgaaatgcgtagatatatggaggaacaccagtggcgaaggcgacggtctggcctgtaactgacgctcattcccgaaagcgtggggagcaaataggattagataccctagtagtccacgccgtaaacgatgagtactaagtgttgggagtcaaatttcagtgctgcagttaacgcaataagtactccgcctgagtagtacgttcgcaagaatgaaactcaaaggaattgacgggggcccgcacaagcggtggagcatgtggtttaattcgaagcaacgcgaagagcgttaccaggtcttgacatccggatgaagacctcataaatgagggcttcagtaagccatagaaaccgggctgctggagtccagcagctcgtgtcgtgagatgttgggttaagtcccgcaacgagcgcaacccttgtcgctagttaccatcattaagttggggactctagcgagactgccagtgacaagctggaggaaggcggggatgacgtcaaatcatcatgccccttatgacctgggctacacacgtgctacaatggatggagcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccatgagagttgataacacccgaagccggtggcctaaccgcaaggag

SEQ ID NO: 645 - DNA, 1516 bp, Clostridium sporogenes
ttaaaattgagagtttgatcctggctcaggacgaacgctggcggcgtgcttaacacatgcaagtcgagcgatgaagcttccttcgggaagtggattagcggcggacgggtgagtaacacgtgggtaacctgcctcaaagtgggggatagccttccgaaaggaagattaataccgcataacataagagaatcgcatgattttcttatcaaagatttattgctttgagatggacccgcggcgcattagctagttggtaaggtaacggcttaccaaggcaacgatgcgtagccgacctgagagggtgatcggccacattggaactgagacacggtccagactcctacgggaggcagcagtggggaatattgcgcaatgggggaaaccctgacgcagcaacgccgcgtgggtgatgaaggtcttcggattgtaaagccctgttttctgggacgataatgacggtaccagaggaggaagccacggctaactacgtgccagcagccgcggtaatacgtaggtggcgagcgttgtccggatttactgggcgtaaagggtgcgtaggcggatgtttaagtgggatgtgaaatccccgggcttaacctgggggctgcattccaaactggatatctagagtgcaggagaggaaagcggaattcctagtgtagcggtgaaatgcgtagagattaggaagaacaccagtggcgaaggcggctttctggactgtaactgacgctgaggcacgaaagcgtgggtagcaaacaggattagataccctggtagtccacgccgtaaacgatggatactaggtgtagggggtatcaactccccctgtgccgcagttaacacaataagtatcccgcctggggagtacggtcgcaagattaaaactcaaaggaattgacgggggcccgcacaagcagcggagcatgtggtttaattcgaagcaacgcgaagaaccttacctggacttgacatcccttgcatagcctagagataggtgaagcccttcggggcaaggagacaggtggtgcatggttgtcgtcagctcgtgtcgtgagatgttaggttaagtcctgcaacgagcgcaacccttgttattagttgctaccattaagttgagcactctaatgagactgcctgggtaaccaggaggaaggtggggatgacgtcaaatcatcatgccccttatgtccagggctacacacgtgctacaatggtaggtacaataagacgcaagaccgtgaggtggagcaaaacttataaaacctatctcagttcggattgtaggctgcaactcgcctacatgaagctggagttgctagtaatcgcgaatcagaatgtcgcggtgaatacgttcccgggccttgtacacaccgcccgtcacaccatgagagctggtaacacccgaagtccgtgaggtaaccgtaaggagccagcggccgaaggtgggattagtgattggggtgaagtcgtaacaaggtagccgtaggagaacctgcggctggatcacctcctttct

SEQ ID NO: 646 - DNA, 1400 bp, Clostridium sporosphaeroides
  modified_base (1)..(2): a, c, t, g, unknown or other
  modified_base (832)..(832): a, c, t, g, unknown or other
  modified_base (836)..(836): a, c, t, g, unknown or other
  modified_base (862)..(862): a, c, t, g, unknown or other
  modified_base (922)..(922): a, c, t, g, unknown or other
  modified_base (926)..(926): a, c, t, g, unknown or other
  modified_base (1141)..(1141): a, c, t, g, unknown or other
  modified_base (1169)..(1169): a, c, t, g, unknown or other
  modified_base (1272)..(1274): a, c, t, g, unknown or other
  modified_base (1278)..(1278): a, c, t, g, unknown or other
  modified_base (1293)..(1293): a, c, t, g, unknown or other
  modified_base (1375)..(1375): a, c, t, g, unknown or other
  modified_base (1380)..(1381): a, c, t, g, unknown or other
nntgaacttagcttagtggcggacgggtgagtaacgcgtgagtawcctgcctttcrgagggggatamcgttcctgaaaacaacgctaataccgcataatatattggtgtcgcatggcaccggtatcaaaggagcaatccgctgcaagatggactcgcgtccgatyagccagtkgatkgggtaaaggcccaccaaagcgacgatcggtagccgggttgagagactgaacggccacattgggactgagacacggcccagactcctacgggaggcagcagtgggggatattgcacaatggaggaaactctgatgcagcaatgccgcgtgagggaagacggtcttcggattgtaaacctctgtccttggtgaagataatgacggtagccaaggaggaagctccggctaactacgtgccagcagccgcggtaatacgtagggagcaagcgttgtccggatttactgggtgtaaagggtgcgtaggcggctctttaagtcgggcgtgaaagctgtgggcttaacccacaaattgcgttcgaaactggagggcttgagtgaagtagaggtaggcggaattcccggtgtagcggtgaaatgcgtagagatcgggaggaacaccagtggcgaaggcggcctactgggctttaactgacgctgaggcacgaaagcatgggtagcaaacaggattagataccctggtagtccatgccgtaaacgatgattactaggtgtggggggtctgaccccttccgtgccggagttaacacaataagtaatccacctggggagtacggccgcaaggttgaaactcaaaggaattgacgggggcccgcacnagcngtggagtatgtggtttaattcgaagnaacgcgaagaaccttaccaggtgttgacatccaactaacgaggcagagatgcattaggtngctncggggaaagttgagacaggtggtccatggttgtcgtcagctcgtgtcgtgagatgttgggttaagtcccgcaacgagcgcaacccttgtgattagttstacgcaagagcactctaatcagactgccgttgacaaaacggaggaaggtggggacgacgtcaaatcatcatgccccttatgacctgggctacacacgtactacaatggtcgccaacngagggaagccaagccgcgaggtggagcnaacccccaaaagcgatctcagttcggattgtaggctgcaacccgcctacatgaagttggaattgctagtaatcgcggatcagcatgccgcggcgaatacgttnnngggncttgtacacaccgcncgtcacaccatgggagccggtaatacccgaagccaatagtctaaccgcaaggaggacgttgtcgaaggtaggattggcgacnggggnnaagtcgtaacaaggtaacc

SEQ ID NO: 647 - DNA, 1518 bp, Clostridium stercorarium
tgatcctggctcaggacgaacgctggcggcgtgcctaacacatgcaagtcgaacgggatccgtgttacggaggtctttggaccgaagtggcatggtgagagtggcggacgggcgagtaacgcgtgagcaacctgccctatgctgggggataacaccgggaaaccggtgctaataccgcataagaccacagtgacgcatgtcacagtggtaaaagctgaggcggcataggatgggctcgcgtccgattagctagttggtagggtaacggcctaccaaggcgacgatcggtagccggactgagaggttggccggccgcattgggactgagacacggcccagactcctacgggaggcagcagtggggaatattgcgcaatgggggaaaccctgacgcagcgacgccgcgtggaggaagaaggcctttgggttgtaaactcctttgatcggggacgaagatgacggtacccgaagaacaagccacggctaactacgtgccagcagccgcggtaatacgtaggtggcgagcgttgtccggaattactgggtgtaaagggcgtgtaggcggggtgccaagtcaggtgtgaaataccggggcttaacctcgggggtgcatctgaaactggtgctcttgagtgccggagaggaaagcggaattcccagtgtagcggtgaaatgcgtagatattgggaggaacaccagtggcgaaggcggctttctggacggtaactgacgctgaggcgcgaaagcgtggggagcaaacaggattagataccctggtagtccacgctgtaaacgatggatactaggtgtaggaggtatcgaccccttctgtgccgtagttaacacaataagtatcccacctggggagtacggccgcaaggctgaaactcaaaggaattgacgggggcccgcacaagcagtggagcatgtggtttaattcgaagcaacgcgaagaaccttaccagggcttgacatccccctgacggatgtagagatacatcttctccgcaaggagcaggggagacaggtggtgcatggttgtcgtcagctcgtgtcgtgagatgttgggttaagtcccgcaacgagcgcaacccttgtcgttagttgccagcagtaagatgggcactctaacgagactgccggcgagaagtcggaggaaggtggggatgacgtcaaatcatcatgccccttatgtcctgggctacacacgtgctacaatggcgactacagagggaagcaaatccgcgaggaggagcaaatcccgaaaggtcgtcccagttcggattgcaggctgcaactcgcctgcatgaagccggaattgctagtaatggcaggtcagcatctgccgtgaatacgttcccgggctttgtacacaccgcccgtcacaccatgagagctggcaacacccgaagccggtagcctaaccgagaggggggcgccgtcgaaggtggggtcagtgattggggtgaagtcgtaacaaggtagccgtatcggaaggtgcggctggatcacctcctt

SEQ ID NO: 648 - DNA, 1437 bp, Clostridium sticklandii
  modified_base (47)..(49): a, c, t, g, unknown or other
  modified_base (71)..(71): a, c, t, g, unknown or other
  modified_base (90)..(90): a, c, t, g, unknown or other
  modified_base (169)..(169): a, c, t, g, unknown or other
  modified_base (309)..(309): a, c, t, g, unknown or other
  modified_base (339)..(339): a, c, t, g, unknown or other
  modified_base (346)..(346): a, c, t, g, unknown or other
  modified_base (361)..(361): a, c, t, g, unknown or other
  modified_base (426)..(426): a, c, t, g, unknown or other
  modified_base (457)..(457): a, c, t, g, unknown or other
  modified_base (480)..(480): a, c, t, g, unknown or other
  modified_base (494)..(494): a, c, t, g, unknown or other
  modified_base (511)..(511): a, c, t, g, unknown or other
  modified_base (520)..(520): a, c, t, g, unknown or other
  modified_base (568)..(569): a, c, t, g, unknown or other
  modified_base (808)..(808): a, c, t, g, unknown or other
  modified_base (811)..(811): a, c, t, g, unknown or other
  modified_base (857)..(857): a, c, t, g, unknown or other
  modified_base (1040)..(1040): a, c, t, g, unknown or other
  modified_base (1058)..(1058): a, c, t, g, unknown or other
  modified_base (1065)..(1065): a, c, t, g, unknown or other
  modified_base (1117)..(1117): a, c, t, g, unknown or other
  modified_base (1143)..(1144): a, c, t, g, unknown or other
  modified_base (1173)..(1173): a, c, t, g, unknown or other
  modified_base (1246)..(1246): a, c, t, g, unknown or other
  modified_base (1308)..(1308): a, c, t, g, unknown or other
  modified_base (1342)..(1342): a, c, t, g, unknown or other
tatttgagagtttgatcctggctcaggatgaacgctggcggcgtgcnnnacacatgcaagtcgaaaatgcnagcggcggacgggtgcgtnacacgtgggtaacctgcccctatcactgggataacacactgaaaagtgtgctaataccagataacataagcttttggcntcattagcttatcaaagaatttcggatagggatgggcccgcgtctgattagctagttggtgaggtaacggctcaccaaggcaacgatcagtagccgacctgagagggtgatcggccacactggaactgagacacggtccngactcctacgggaggcagcagtggggaatnttgcacnatgggcgaaagcctnatgcagcaacgccgcgtgagcgatgaaggccttcgggtcgtaaagctctgtcctatgggaagatnatgacggtaccataggaggaagccccggctnactacgtgccagcagccgcggtnatacgtagggggcnagcgttatccggaattnctgggcgtnaagggtgcgtaggcggtttatcaagtcaggggtgaaaggctacggctnnaccgtagtgagcctctgaaactggtgaacttgagtgtaggagaggaaagtggaattcccagtgtagcggtgaaatgcgtagatattgggaggaacaccagtggcgaaggcgactttctggactacaactgacgctgaggcacgaaagcgtggggagcaaacaggattagataccctggtagtccacgctgtaaacgatgagtactaggtgtcggctgtcaaaggtcggtgccggcgttnacncattaagtactccgcctggggagtacgctcgcaagagtgaaactcnaaggaattgacggggacccgcacaagtagcggagcatgtggtttaattcgaagcaacgcgaagaaccttacctaggcttgacatccctttgcaaagyccttaaccggrctcctyttsttcgsaaracaaaggtgacaggtggtgcatggttgtcgtcagctcgtgtcgtgagatgttgggttnagtcccgcaacgagcgcnacccctntttttagttgccatcagttaggctgggcactctagaaagactgccgaggacnactcggaggaaggtggggatgacgtnnaatcatcatgccccttatgcttagggctncacacgtgctacaatggctgttacaaagggctgcgagaccgcgaggtggagccaatcccagaaaaacagtctnagttcggattgtaggctgaaactcgcctacatgaagccggagttactagtaatcgcagatcngaatgctgcggtgaatgcgttcccgggtcttgtncacaccgcccgtcacaccatggaagttgggggcacccaaagttagttatccaaccttacgggggaggctacctaaggtgaattcaatgactgggg

SEQ ID NO: 649 - DNA, 1447 bp, Clostridium straminisolvens
  modified_base (56)..(56): a, c, t, g, unknown or other
gacgaacgctggcggcgtgcctaacacatgcaagtcgagcggagatatattgaagntttatcggatatatatcttagcggcggacgggtgagtaacgcgtgggtaacctgcctcatacagggggataacacagggaaacttgtgctaataccgcataacataacgaggcggcatcgctttgttatcaaaggagcaatccggtatgagatgggcccgcgtccgattagctagttggtgaggtaacggctcaccaaggcgacgatcggtagccgaactgagaggttgatcggccacattgggactgagacacggcccagactcctacgggaggcagcagtggggaatattgcgcaatgggggaaaccctgacgcagcaacgccgcgtgaaggaagaaggccttcgggttgtaaacttctttgattggggacgaagaaagtgactgtacccaaaaaacaagccacggctaactacgtgccagcagccgcggtaatacgtaggtggcaagcgttgtccggaattactgggtgtaaagggcgtgtaggcggggatgcaagtcagatgtgaaattccggggcttaaccccggcgctgcatctgaaactgtatctcttgagtgctggagaggaaagcggaattcctagtgtagcggtgaaatgcgtagatattaggaggaacaccagtggcgaaggcggctttctggacagtaactgacgctgaggcgcgaaagcgtggggagcaaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacatcccttgaaagtcctagagataggatttctcttcggagcaaggagacaggtggtgcatggttgtcgtcagctcgtgtcgtgagatgttgggttaagtcccgcaacgagcgcaacccctgttgttagttgccatcattaagttgggcactctagcgagactgccggtgacaaatcggaggaaggtggggacgacgtcaaatcatcatgccccttatgtcctgggctacacacgtactacaatggctgttacaaagggaagctaagccgcgaggtggagcaaatccccaaaggcagccccagttcagattgcaggctgaaactcgcctgcatgaagtcggaattgctagtaatggcaggtcagcatactgccgtgaatacgttcccgggccttgtacacaccgcccgtcacaccatgagagtctgcaacacccgaagtcagtagtctaaccgcaaggaggacgctgccgaaggtggggccgatgattggggtga

SEQ ID NO: 650 - DNA, 1504 bp, Clostridium subterminale
agagggttgatcatggctcaggacgaacgctggcggcgtgcctaacacatgcaagtcgagcgatgaagcccttcggggtgaattagcggcggacgggtgagtaacacgtgggtaacctgccttatagagggggatagccttccgaaaggaagattaataccgcataatatgtttttatcgcatggtagaaacatcaaaggagcaatccgctataagatggacccgcggcgcattagctagttggtgaggtaacggcccaccaaggcgacgatgcgtagccgacctgagagggtgatcggccacattggaactgagacacggtccagactcctacgggaggcagcagtggggaatattgcgcaatgggggaaaccctgacgcagcaacgccgcgtgaatgaagaaggccttagggttgtaaagttctgttttctgggacgataatgacggtaccagaggaggaagccagggctaactacgtgccagcagccgcggtaatacgtaggtggcaagcgttgtccggatttactgggcgtaaaggatgcgtaggcggatgtttaagtgagatgtgaaatacccgagctcaacttgggtgctgcatttcaaactggatatctagagtgcaggagaggaaagcggaattcctagtgtagcggtgaaatgcgtagagattaggaagaacaccagtggcgaaggcggctttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctggggagtacgatcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttatcattagttgctaccattaagttgagcactctagtgagactgccacggttaacgtggaggaaggtggggatgacgtcaaatcatcatgccccttatgtctagggctacacacgtgctacaatggtgaatacaaatagatgcaataccgcgaggtggagccaaactataaaattcatcccagttcggattgtagtctgaaactcgactacatgaagccggagttgctagtaatcgcgaatcagcatgtcgcggtgaatacgttcccgggccttgtacacaccgcccgtcacaccatgagagctggtaacacccgaagtccgtgaggtaaccgtaaggagccagcggccgaaggtgggattagtgattggggtgaagtcgtaacaaggtagccgtaggagaacctgcggttggatcaccttcctta

SEQ ID NO: 651 - DNA, 1504 bp, Clostridium sulfidigenes
tgagtttgatcctggctcaggacgaacgctggcggcgtgcctaacacatgcaagtcgagcgatgaagcccttcggggtgaattagcggcggacgggtgagtaacacgtgggtaacctgccttatagagggggatagccttccgaaaggaagattaataccgcatgaaatgtttttatcgcatggtagaaacatcaaaggagtaatccgctataagatggacccgcggcgcattagctagttggtgaggtaacggcccaccaaggcgacgatgcgtagccgacctgagagggtgatcggccacattggaactgagacacggtccagactcctacgggaggcagcagtggggaatattgcgcaatgggggaaaccctgacgcagcaacgccgcgtgaatgaagaaggccttagggttgtaaagttctgttttctgggacgataatgacggtaccagaggaggaagccacggctaactacgtgccagcagccgcggtaatacgtaggtggcaagcgttgtccggatttactgggcgtaaaggatgcgtaggcggatgtttaagtgagatgtgaaatacccgagctcaacttgggtgctgcatttcaaactggatatctagagtgcaggagaggaaagcggaattcctagtgtagcggtgaaatgcgtagagattaggaagaacaccagtggcgaaggcggctttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctggggagtacgatcgcaagattaaaactcaaaggaattgacgggggcccgcacaagcagcggagcatgtggtttaattcgaagcaacgcgaagaaccttacctagacttgacatctcctgaattacccttaaccggggaaagcttcggggcaggaagacaggtggtgcatggttgtcgtcagctcgtgtcgtgagatgttgggttaagtcccgcaacgagcgcaacccttatcattagttgctaccattaagttgagcactctagtgagactgccacggttaacgtggaggaaggtggggatgacgtcaaatcatcatgccccttatgtctagggctacacacgtgctacaatggtgaatacaaatagatgcaataccgcgaggtggagccaaactataaaattcatcccagttcggattgtagtctgaaactcgactacatgaagccggagttgctagtaatcgcgaatcagcatgtcgcggtgaatacgttcccgggccttgtacacaccgcccgtcacaccatgagagctggtaacacccgaagtccgtgaggtaaccgtaaggagccagcggccgaaggtgggattagtgattggggtgaagtcgtaacaaggtagccgtaggagaacctgcggctggatcacctcctttcta

SEQ ID NO: 652 - DNA, 1384 bp, Clostridium symbiosum
gaacgaagcgatttaacggaagttttcggatggaagttgaattgactgagtggcggacgggtgagtaacgcgtgggtaacctgccttgtactgggggacaacagttagaaatgactgctaataccgcataagcgcacagtatcgcatgatacagtgtgaaaaactccggtggtacaagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccgcggctcaactgcgggactgctttggaaactgtttaactggagtgtcggagaggtaagtggaattcctagtgtagcggtgaaatgcgtagatattaggaggaacaccagtggcgaaggcgacttactggacgataactgacgttgaggctcgaaagcgtggggagcaaacaggattagataccctggtagtccacgccgtaaacgatgaatactaggtgttggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatcgatccgacgggggagtaacgtccccttcccttcggggcggagaagaaaggtggtgcatggagtgtcggagctcgtgtcgtgagatgttgggttaagtcccgcaacgagcgcaacccttattctaagtagccagcggttcggccgggaactcttgggagactgccagggataacctggaggaaggtggggatgacgtcaaatcatcatgccccttatgatctgggctacacacgtgctacaatggcgtaaacaaagagaagcaagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagg

SEQ ID NO: 653 - DNA, 1378 bp, Clostridium tertium
gtcgagcgagaggagttccttcgggaacaaatctagcggcggacgggtgagtaacacgtgggcaacctgccttgtagaggggaatagccttccgaaaggaagattaataccgcataacattacattttcgcatgaagaagtaattaaaggagcaatccgctacaagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtcttcagggacgataatgacggtacctgaggaggaagccacggctaactacgtgccagcagccgcggtaatacgtaggtggcgagcgttgtccggatttactgggcgtaaagggagcgtaggcggatttttaagtgagatgtgaaatacccgggctcaacttgggtgctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggttgtcatgacctctgtgccgccgcaaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgcattactcttaatcgaggaagtcccttcggggacaggatgacaggtggtgcatgggcgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagatgcgataccgcgaggtggagctaaactataaaacttgtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacccgtaagggaggcagcga

SEQ ID NO: 654 - DNA, 1515 bp, Clostridium tetani
taaattgagagtttgatcctggctcaggacgaacgctggcggcgtgcttaacacatgcaagtcgagcgatgaagcttccttcgggaagtggattagcggcggacgggtgagtaacacgtgggcaacctgcctcaaagaggggaatagccctccgaaaggaggattaataccgcataaagttaaggtttcgcatgaaactttaaccaaaggagtaatctgctttgagatgggcccgcgccccattagctagttggtaaggtaatggcttaccaaggcgacgatgggtagccgacctgagagggtgatcggccacattggaactgagacacggtccagactcctacgggaggcagcagtggggaatattgcgcaatgggggaaaccctgacgcagcaacgccgcgtgggtgatgaaggttttcggatcgtaaaaccctgttttctgggacgataatgacggtaccagatgaggaagccacggctaactacgtgccagcagccgcggtaatacgtaggtggcaagcgttgtccggatttactgggcgtaaagggtgcgtaggcggatgcttaagtgagatgtgaaatacctaagcttaacttaggggctgcatttcaaactgggcatctagagtacaggagagggaaacggaattcctagtgtagcggtgaaatgcgtagagattaggaagaacaccagtggcgaaggcggtttcctggactgtaactgacgctgaggcacgaaagcgtgggtagcaaacaggattagataccctggtagtccacgccgtaaacgatgaatactaggtgtaggagggtccaaccttctgtgccgcagttaacacattaagtattccgcctggggagtacggtcgcaagactaaaactcaaaggaattgacgggggcccgcacaagcagcggagcatgtggtttaattcgaagcaacgcgaagaaccttacctagacttgacataccctgaattactcgtaactgaggaagtcccttcggggacagggatacaggtggtgcatggttgtcgtcagctcgtgtcgtgagatgttgggttaagtcccgcaacgagcgcaacccttattattagttgctaccattaagttgagcactctaatgagactgcctgggtgaaccaggaggaaggtggggatgacgtcaaatcatcatgccccttatgtctagggctacacacgtgctacaatggtcggtacagagagacgcaagaccgcgaggtggagcaaatctcaaaaaccgatcccagttcggattgcaggctgaaactcgcctgcatgaagccggagttgctagtaatcgcaaatcagaatgttgcggtgaatacgttcccgggccttgtacacaccgcccgtcacaccatgagagttggcaacacccgaagtccgtgaggtaaccgtaaggagccagcggccgaaggtggggttaatgattggggtgaagtcgtaacaaggtagccgtaggagaacctgcggctggatcacctcctttct

SEQ ID NO: 655 - DNA, 1521 bp, Clostridium thermocellum
agagtttgatcctggctcaggacgaacgctggcggcgtgcctaacacatgcaagtcgagcggggatatacggaaggtttaccggaagtatatcctagcggcggacgggtgagtaacgcgtgggtaacctacctcatacagggggataacacagggaaacctgtgctaataccgcataatataacggggcggcatcgtcctgttatcaaaggagaaatccggtatgagatgggcccgcgtccgattagctggttggtgaggtaacggctcaccaaggcgacgatcggtagccgaactgagaggttggtcggccacattgggactgagacacggcccagactcctacgggaggcagcagtggggaatattgcgcaatgggggaaaccctgacgcagcaacgccgcgtgaaggaagaaggccttcgggttgtaaacttctttgattggggacgaaggaagtgacggtacccaaagaacaagccacggctaactacgtgccagcagccgcggtaatacgtaggtggcgagcgttgtccggaattactgggtgtaaagggcgcgtaggcggggatgcaagtcagatgtgaaattccggggcttaaccccggcgctgcatctgaaactgtatctcttgagtgctggagaggaaagcggaattcctagtgtagcggtgaaatgcgtagatattaggaggaacaccagtggcgaaggcggctttctggacagtaactgacgctgaggcgcgaaagcgtggggagcaaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacatccctctgacagctctagagatagggcttcccttcggggcagaggagacaggtggtgcatggttgtcgtcagctcgtgtcgtgagatgttgggttaagtcccgcaacgagcgcaacccttgtcgttagttgccagcacgttaaggtgggcactctagcgagactgccggcgacaagtcggaggaaggtggggacgacgtcaaatcatcatgccccttatgtcctgggctacacacgtactacaatggctgctacaaagggaagcgataccgcgaggtggagcaaatccccaaaagcagtcccagttcggattgcaggctgaaactcgcctgcatgaagtcggaattgctagtaatggcaggtcagcatactgccgtgaatacgttcccgggccttgtacacaccgcccgtcacaccatgagagtctgcaacacccgaagtcagtagtctaaccgtaaggagggcgctgccgaaggtggggcagatgattggggtgaagtcgtaacaaggtagccgtatcggaaggtgcggctggatcacctccttt

SEQ ID NO: 656 - DNA, 1360 bp, Clostridium tyrobutyricum
agcgatgaaaccccttcgggggtggattagcggcggacgggtgagtaacacgtgggtaacctgcctcaaagtgggggatagccttccgaaaggaagattaataccgcataaagccaagtttcacatggaatttggatgaaaggagtaattcgctttgagatggacccgcggcgcattagttagttggtggggtaatggcctaccaagacagcgatgcgtagccgacctgagagggtgatcggccacattggaactgagatacggtccagactcctacgggaggcagcagtggggaatattgcacaatgggcgaaagcctgatgcagcaacgccgcgtgagtgatgaaggtcttcggattgtaaagctctgtcttttgggacgataatgacggtaccaaaggaggaagccacggctaactacgtgccagcagccgcggtaatacgtaggtggcgagcgttgtccggatttactgggcgtaaagggtgcgtaggcggatgtttaagtgagatgtgaaatacccgggcttaacttgggtgctgcatttcaaactggatatctagagtgcaggagaggagaatggaattcctagtgtagcggtgaaatgcgtagagattaggaagaacaccagtggcgaaggcgattctctggactgtaactgacgctgaggcacgaaagcgtgggtagcaaacaggattagataccctggtagtccacgccgtaaacgatgagtactaggtgtaggaggtatcgaccccttctgtgccgcagtaaacacattaagtactccgcctgggaagtacgatcgcaagattaaaactcaaaggaattgacgggggcccgcacaagcagcggagcatgtggtttaattcgaagcaacgcgaagaaccttacctggacttgacatcccctgaataacctagagataggcgaagcccttcggggcagggagacaggtggtgcatggttgtcgtcagctcgtgtcgtgagatgttaggttaagtcctgcaacgagcgcaacccttattgttagttgctaacattcagttgagcactctaacgagactgccgcggttaacgcggaggaaggtggggatgacgtcaaatcatcatgccccttatgtccagggcaacacacgtgctacaatgggcagaacaaagagaagcaataccgcgaggtggagccaaactcaaaaactgctctcagttcggattgcaggctgaaactcgcctgcatgaagctggagttgctagtaatcgcgaatcagcatgtcgcggtgaatacgttcccgggccttgtacacaccgcccgtcacaccatgagagctggcaacacccgaagtccgtagtctaacgtaagag

SEQ ID NO: 657 - DNA, 1482 bp, Clostridium viride
  modified_base (746)..(746): a, c, t, g, unknown or other
gatgaacgctggcggcgtgcttaacacatgcaagtcgaacggagccatctggaacaagttttcggacaagggaaagatgtgcttagtggcggacgggtgagtaacgcgtgagtaacctgccttggagtggggaataacacatcgaaaggtgtgctaataccgcatgatgcaacgggatcgcatggttctgttgccaaagatttatcgctctgagatggactcgcgtctgattagctagttggtgaggtaatggctcaccaaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggccctcgggttgtaaacttcttttattcgagacgaaacaaatgacggtaccgaatgaataagccacggctaactacgtgccagcagccgcggtaatacgtaggtggcaagcgttatccggatttactgggtgtaaagggcgtgtaggcgggactgcaagtcagatgtgaaattccagggctcaactctggacctgcatttgaaactgtagttcttgagtgatggagaggcaggcggaattccgagtgtagcggtgaaatgcgtagatattcggaggaacaccagtggcgaaggcggcctgctggacattaactgacgctgaggcgcgaaagcgtggggagcanacaggattagataccctggtagtccacgctgtaaacgatggatactaggtgtggggggactgaccccttccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatccctctgaccggtctagagataggccctccctcggggcagaggtgacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggctacacacgtactacaatggcgcttaacagagggaggcaataccgcgaggtggagcaaacccctaaaaggcgtcccagttcggattgcaggctgaaacccgcctgtatgaagttggaatcgctagtaatcgcggatcagcatgccgcggtgaatacgttcccgggtcttgtacacaccgcccgtcacaccatgagagtcgggaacacccgaagtccgtagcctaacagcaatgagggcgcggccgaaggtgggttcgataattggggtgaagtcgtaacaaggtagccgtatcggaaggtgc

SEQ ID NO: 658 - DNA, 1441 bp, Clostridium xylanolyticum
  modified_base (830)..(830): a, c, t, g, unknown or other
  modified_base (1001)..(1001): a, c, t, g, unknown or other
  modified_base (1386)..(1386): a, c, t, g, unknown or other
gatcctggctcaggatgaacgctggcggcgtgcttaacacatgcaagtcgagcgaagcattttaaaggaagttttcggatggaatttagaatgacttagcggcggacgggtgagtaacgcgtgggtaacctgcctcatacagggggataacagttagaaatgactgctaataccgcataagcgcacagtgctgcatagtacagtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggctctgcaagtctggagtgaaagcccggggctcaaccccgggactgctttggaaactgtggagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtnccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccgtctcgtaacggagacctnccttcggggcattccagacaggtggtgcatggttgtcgtcagctcgtgtcgtgagatgttgggttaagtcccgcaacgagcgcaacccttatccttagtagccagcatgtwatggtgggcactctggggagactgccagggataacctggaggaaggtggggatgacgtcaaatcatcatgccccttatgatttgggctacacacgtgctacaatggcgtaaacaaagggaagcaaaggagcgatctggagcaaatcccaaaaataacgtctcagttcggattgtagtctgcaactcgactacatgaagctggaatcgctagtaatcgcagatcagaatgctgcggtgaatacgttcccgggtcttgtacacaccgcccgtcacnccatgggagttggtaacgcccgaagtcagtgacccaaccgtaaggagggagctgc

SEQ ID NO: 659 - DNA, 1357 bp, Collinsella aerofaciens
  modified_base (766)..(766): a, c, t, g, unknown or other
acggcacccctctccggagggaagcgagtggcgaacggctgagtaacacgtggagaacctgccccctcccccgggatagccgcccgaaaggacgggtaataccggatacccccgggcgccgcatggcgcccgggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctgggtgtggggggacgatccccccgtgccgcagccnacgcattaagcgtcccgcctggggagtacggccgcaaggctaaaactcaaaggaattgacgggggcccgcacaagcagcggagcatgtggcttaattcgaagcaacgcgaagaaccttacggcgcatccccccgaggcccacggggggtccgccgcgtgggtcagaggagcgcatacgggaggtgcatggttgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggg

SEQ ID NO: 660 - DNA, 1340 bp, Collinsella intestinalis
gaacggcacccaccctcgggtggaagcgagtggcgaacggctgagtaacacgtggagaacccgccccctcctccgggatagcctcgggaaaccgtgggtaataccggatgaccccgcagggccgcatggccccgcgggcaaagcccagacgggaggggatggctccgcggcccatcaggtagacggcggggtgacggcccaccgtgccgacgacgggtagccgggttgagagaccgaccggccagattgggactgagacacggcccagactcctacgggaggcagcagtggggaatcttgcgcaatggggggaaccctgacgcagcgacgccgcgtgcgggacgaaggccctcgggtcgtaaaccgctttcagcaggatgagacaagacggtacctgcagaagaagccccggctaactacgtgccagcagccgcggtaatacgtagggggcgagcgttatccggattcattgggcgtaaagcgcgcgtaggcggcccggcaggcagggggtcaaatggcggggctcaaccccgtcccgccccctgaaccgccgggctcgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgaccgtgaagccggggagacccggtggccgagaggagcggtcacaggtggtgcatggctgtcgtcagctcgtgtcgtgagatgtttggataacggcggcgaaggccgcaacccccgccgcatgttgccagcacctcgggtgggcacccatgcgggaccgccggagtcaatccggaggagggcggggacgacgtcaagtcatcatgccccttatgccctgggctgcacacgtgctacaatggccggtacagcgggatgcgatggcgcgagccggagcggatccctgaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccg

SEQ ID NO: 661 - DNA, 1264 bp, Collinsella stercoris
  modified_base (1223)..(1224): a, c, t, g, unknown or other
gccccctcctccgggatagcctcgggaaaccgtgggtaataccggatgaccccggcaggccgcatggccggccgggcaaagcccagacgggaggggatggctccgcggcccatcaggtagacggcggggtgacggcccaccgtgccgacgacgggtagccgggttgagagaccgaccggccagattgggactgagacacggcccacactcctacgggaggcagcagtggggaatcttgcgcaatggggggaaccctgacgcagcgacgccgcgtgcgggacgaaggccctcgggtcgtaaaccgctttcagcggaacaaacgtgcagaagaagccccggctaactacgtgccagcagccgcggtatacgtagggggcgagcgttatccggattcattgggcgtaaagcgcgcgtagcggcccggcaggcagggggtcaaatggcggggctcaaccccgtcccgccccctgaaccgccgggctcggtccggtaggggagggtggaacacccggtgtacggtggaatgcgcagatatcgggtggaacaccggtggcgaagcggcctctgggccgaaccgacgctgagcgcgaaagctgggggagcgaacaggattaaataccctggtagtcccagccgtaaacgatggacgctaggtgtgggaggggaacccttccgtgccgcagcccacgcattaggcgtcccgcctggggagtacggccgcaaggctaaaactccaaggaattgactgggggccctcaaagcagcggagcatgtggcttaattcgaagcaacgcgaagaaccttaccagggcttgacatgcgcgtgaagccggggagacccggtggccgagaggagcgcgcacaggtggtgcatggctgtcgtcagctcgtgtcgtgagatgtttggttaagtccagcaacgagcgcaacccccgccgcatgttgccagcacctcgggtgggcacccatgcgggaccgccggagtcaatccggaggagggcggggacgacgtcaagtcatcatgccccttatgccctgggctgcacacgtgctacaatggccggtacagcgggatgcgatggcgcgagccggagcggatccctgaaagccggccccagttcggattgggggctgcaacccgcccccatgaagtcggagttgctagtaatcgcggatcagcatgccgcggtgaatgcgttcccgggccttgtacacaccgcccnncacaccacccgagtcgtctgcacccgaagtcgccggccca

SEQ ID NO: 662 - DNA, 1356 bp, Collinsella tanakaei
tcatggctcaggatgaacgctggcggcgcgcctaacacatgcaagtcgaacgagtggcgaacggctgagtaacacgtggagaacctgccccctcctcggggatagccgcgggaaaccgcgggtaacacccgacgaccaaatgagggaggggatggctccgcggcccatcaggtagacggcggggtaacggcccaccgtgccgacaacgggtagccgggttgagagaccgaccggccagattgggactgagacacggcccagactcctacgggaggcagcagtggggaatcttgcgcaatgggggcaaccctgacgcagcgacgccgcgtgcgggacgaaggccttcgggtcgtaaaccgctttcagcagggacgaagacggtacctgcagaagaagccccggctaactacgtgccagcagccgcggtaatacgtagggggcgagcgttatccggattcattgggcgtaaagcgcgcgtaggcggccgcgtaggcggggggtcaaatcccggggctcaaccccggtccgccccccgaaccccgcggctcgggtccggtaggggagggtggaattcccggtgtagcggtggaatgcgcagatatcgggaggaacaccggtggcgaaggcggccctctgggccgaccgacgctgaggcgcgaaagctgggggagcgaacaggattagataccctggtagtcccagccgtaaacgatggacgctaggtgtgggggcctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgcacaggtggtgcatggctgtcgtcagctcgtgtcgtgagatgttgggttaagtcccgcaacgagcgcaacccccgccgcatgttgccagcagctgggcacccatgcgggaccgccggcgtcaagccggaggagggcggggacgacgtcaagtcatcatgccccttatgccctgggctgcacacgtgctacaatggccggcagcgggatgcgatggcgcgagccggagcggatccctcccggccccagttcggatgggggctgcaacccgcccccagaagtcggagttgctagtaatcgcggatcagcatgccgcggtgaatgcgttcccgggccttgtacacaccgcccgtcacaccacccgagtcgtctgcacccgaagccgccgcccagggaggcgtcgaaggtgtggagggtgaggggggtgaagtcgtaacaaggtagccgtacgggaacgtgcggctggatcacctcct

SEQ ID NO: 663 - DNA, 1505 bp, Comamonadaceae bacterium NML000135
attgaacgctggcggcatgctttacacatgcaagtcgaacggtaacatgggtgcttgcacctgatgacgagtggcgaacgggtgagtaatacatcggaacatgcccaattgtgggggatagctcggcgaaagccggattaataccgcataagatctacggatgaaagcaggggaccttcgggccttgcgcgattggagtggccgatggcagattaggtagttggtggggtaaaggcctaccaagcctgcgatctgtagctggtctgagaggacgaccagccacactgggactgagacacggcccagactcctacgggaggcagcagtggggaattttggacaatgggcgcaagcctgatccagcaatgccgcgtgcaggacgaaggccttcgggttgtaaactgcttttgtgcagaacgaaaaatctctggttaatacctggggatcatgacggtactgcaagaataagcaccggctaactacgtgccagcagccgcggtaatacgtagggtgcgagcgttaatcggaattactgggcgtaaagcgtgcgcaggcggcgatgcaagaccgatgtgaaatccccgggctcaacctgggaactgcattagtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggggattcatttcttcagtaacgaagctaacgcgtgaagttgaccgcctggggagtacggtcgcaagactaaaactcaaaggaattgacggggacccgcacaagcggtggatgatgtggtttaattcgatgcaacgcgaaaaaccttacccacctttgacatgtacggaacttgccagagatggcttggtgctcgaaagagagccgtaacacaggtgctgcatggctgtcgtcagctcgtgtcgtgagatgttgggttaagtcccgcaacgagcgcaacccttgtcattagttgccatcatttagttgggcactctaatgagactgccggtgataaaccggaggaaggtggggatgacgtcaagtcctcatggcccttataggtggggctacacacgtcatacaatggccggtacaaagggcagccaacccgcgagggggagccaatcccataaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagcttaaccgtaaggagggcgcttaccacggcagggctcgtgactggggtgaagtcgtaacaaggtagccgtaccggaaggtgcggctggatcacc

SEQ ID NO: 664 - DNA, 1450 bp, Comamonadaceae bacterium NML790751
tacacatgcaagtcgaacggtaacatgggtgcttgcacctgatgacgagtggcgaacgggtgagtaatacatcggaacatgcccaattgtgggggatagctcggcgaaagccggattaataccgcataagatctacggatgaaagcaggggaccttcgggccttgcgcgattggagtggccgatggcagattaggtagttggtggggtaaaggcctaccaagcctgcgatctgtagctggtctgagaggacgaccagccacactgggactgagacacggcccagactcctacgggaggcagcagtggggaattttggacaatgggcgcaagcctgatccagcaatgccgcgtgcaggacgaaggccttcgggttgtaaactgcttttgtacagaacgaaaagtctctggttaatacctggggaacatgacggtactgtaagaataagcaccggctaactacgtgccagcagccgcggtaatacgtagggtgcgagcgttaatcggaattactgggcgtaaagcgtgcgcaggcggcgatgcaagaccgatgtgaaatccccgggctcaacctgggaactgcattagtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggggattcatttcttcagtaacgaagctaacgcgtgaagttgaccgcctggggagtacggtcgcaagactaaaactcaaaggaattgacggggacccgcacaagcggtggatgatgtggtttaattcgatgcaacgcgaaaaaccttacccacctttgacatgtacggaacttgccagagatggcttggtgctcgaaagagagccgtaacacaggtgctgcatggctgtcgtcagctcgtgtcgtgagatgttgggttaagtcccgcaacgagcgcaacccttgtcattagttgccatcatttagttgggcactctaatgagactgccggtgataaaccggaggaaggtggggatgacgtcaagtcctcatggcccttataggtggggctacacacgtcatacaatggccggtacaaagggcagccaacccgcgagggggagccaatcccataaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagtcttaaccgtaaggagggcgcttaccacggcagggctcgtgactggggtgaagtcgtaaca

SEQ ID NO: 665 - DNA, 1485 bp, Comamonadaceae bacterium NML910035
aacgctggcggcatgctttacacatgcaagtcgaacggtaacatgggtgcttgcacctgatgacgagtggcgaacgggtgagtaatacatcggaacatgcccaattgtgggggatagctcggcgaaagccggattaataccgcataagatctacggatgaaagcaggggaccttcgggccttgcgcgattggagtggccgatggcagattaggtagttggtggggtaaaggcctaccaagcctgcgatctgtagctggtctgagaggacgaccagccacactgggactgagacacggcccagactcctacgggaggcagcagtggggaattttggacaatgggcgcaagcctgatccagcaatgccgcgtgcaggacgaaggccttcgggttgtaaactgcttttgtacagaacgaaaagtctctggttaatacctggggatcatgacggtactgtaagaataagcaccggctaactacgtgccagcagccgcggtaatacgtagggtgcgagcgttaatcggaattactgggcgtaaagcgtgcgcaggcggcgatgcaagaccgatgtgaaatccccgggctcaacctgggaactgcattagtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggggattcatttcttcagtaacgaagctaacgcgtgaagttgaccgcctggggagtacggtcgcaagactaaaactcaaaggaattgacggggacccgcacaagcggtggatgatgtggtttaattcgatgcaacgcgaaaaaccttacccacctttgacatgtacggaacttgccagagatggcttggtgctcgaaagagagccgtaacacaggtgctgcatggctgtcgtcagctcgtgtcgtgagatgttgggttaagtcccgcaacgagcgcaacccttgtcattagttgccatcattaagttgggcactctaatgagactgccggtgataaaccggaggaaggtggggatgacgtcaagtcctcatggcccttataggtggggctacacacgtcatacaatggccggtacaaagggcaggcaacccgcgagggggagcaaatcccataaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagcttaaccgtaaggagggcgcttaccacggcagggctcgtgactggggtgaagtcgtaacaaggtagccgtaccggaag

SEQ ID NO: 666 - DNA, 1480 bp, Comamonadaceae bacterium NML910036
attgaacgctggcggcatgctttacacatgcaagtcgaacggtaacatgggtgcttgcacctgatgacgagtggcgaacgggtgagtaatacatcggaacatgcccaattgtgggggatagctcggcgaaagccggattaataccgcataagatctacggatgaaagcaggggaccttcgggccttgcgcgattggagtggccgatggcagattaggtagttggtggggtaaaggcctaccaagcctgcgatctgtagctggtctgagaggacggccagccacactgggactgagacacggcccagactcctacgggaggcagcagtggggaattttggacaatgggcgcaagcctgatccagcaatgccgcgtgcaggacgaaggccttcgggttgtaaactgcttttgtacagaacgaaaagtctctggttaatacctggggatcatgacggtactgtaagaataagcaccggctaactacgtgccagcagccgcggtaatacgtagggtgcgagcgttaatcggaattactgggcgtaaagcgtgcgcaggcggcgatgcaagaccgatgtgaaatccccgggctcaacctgggaactgcattagtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggggattcatttcttcagtaacgaagctaacgcgtgaagttgaccgcctggggagtacggtcgcaagactaaaactcaaaggaattgacggggacccgcacaagcggtggatgatgtggtttaattcgatgcaacgcgaaaaaccttacccacctttgacatgtacggaacttgccagagatggcttggtgctcgaaagagagccgtaacacaggtgctgcatggctgtcgtcagctcgtgtcgtgagatgttgggttaagtcccgcaacgagcgcaacccttgtcattagttgccatcattaagttgggcactctaatgagactgccggtgataaaccggaggaaggtggggatgacgtcaagtcctcatggcccttataggtggggctacacacgtcatacaatggccggtacaaagggcagccaacccgcgagggggagcaaatcccataaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagcttaaccgtaaggagggcgcttaccacggcagggctcgtgactggggtgaagtcgtaacaaggtagccg

SEQ ID NO: 667 - DNA, 1499 bp, Comamonadaceae bacterium oral taxon F47
agagtttgatcctggctcagattgaacgctggcggcatgctttacacatgcaagtcgaacggcagcggagaggtgcttgcacttctgccggcgagtggcgaacgggtgagtaatgtatcggaacgtgcccagtagtgggggataactactcgaaagagtggctaataccgcatgagatctctggatgaaagcgggggaccgtaaggcctcgcgctactggagcggccgatatcagattaggtagttggtggggtaaaggcctaccaagcctgcgatctgtagctggtttgagaggacgaccagccacactgggactgagacacggcccagactcctacgggaggcagcagtggggaattttggacaatgggcgcaagcctgatccagcaatgccgcgtgcaggacgaaggccttcgggttgtaaactgcttttgtacagaacgaaaagctcttctctaatacaggggggtaatgacggtactgtaagaataagcgccggctaactacgtgccagcagccgcggtaatacgtagggtgcgagcgttaatcggaattactgggcgtaaagcgtgcgcaggcggttttgtaagacagaggtgaaatccccgggcttaacctgggaactgcctttgtgactgcaaggcttgagtgcggcagagggggatggaattccgcgtgtagcagtgaaatgcgtagatatgcggaggaacaccgatggcgaaggcagtcccctgggcctgcactgacgctcatgcacgaaagcgtggggagcaaacaggattagataccctggtagtccacgccctaaacgatgtcaactggttgttggaatttattttttcagtaacgttgctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatggcaggaagtttccagagatggattcgtgctcgcaagagagcctgcacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggccggtacaaagggtagccaacccgcgagggggagccaatcccgcaaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtggttagcctaaccgcaaggagggcgatcaccacggcagggttcgtgactggggtgaagtcgtaacaaggtagccgt

SEQ ID NO: 668 - DNA, 1521 bp, Comamonas sp.
  NSP5
agagtttgatcctggctcagattgaacgctggcggcatgctttacacatgcaagtcgaacggtaacaggccgcaaggtgctgacgagtggcgaacgggtgagtaacacatcggaacgtgcccagttgtgggggataactactcgaaagagtagctaataccgcatgagaacttaggttgaaagcaggggaccgcaagaccttgcgcaaacagagcggccgatggcagattaggtagttggtgggataaaggcttaccaagccgacgatctgtagctggtctgagaggacgaccagccacactgggactgagacacggcccagactcctacgggaggcagcagtggggaatttgggacaatgggcgcaagcctgatccagcaatgccgcgtgcaggatgaaggccttcgggttgtaaactgctttggtacggaacgaaaaagctctggttaatacctggggcccatgacggtaccgtaagaataagcaccggctaactacgtgccagcagccgcggtaatacgtagggtgcaagcgttaatcggaattactgggcgtaaagcgtgcgcaggcggttatgtaagacagaggtgaaatccccgggctcaacctgggaactgcctttgtgactgcatagctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggtattcactttctcagtaacgaagctaacgcgtgaagttgaccccctggggagtacggccccaaggttaaaactcaaaggaattgacggggacccgcacaagcggtggatgatgtggtttaattcgatgcaacgcgaaaaaccttacccacctttgacatgtacggaaccctttagagatagaggggtgctcgaaagagaaccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggccggtacaaagggtagccaacccgcgaggtggagctaatcccataaagccggtcgtagtccggatcgcagtctgcaactcgactgcgtgaagtcggaatcgctagtaatcgtggatcagaatgtcacggtgaatacgttcccgggtcttgtacacaccgaccgtcacaccatgggagcgggttctgccagaagtaggtagcctaaccgtaaggagggcgcttaccacggcggggttcgtgactggggtgaagtcgtaacaaggtagccgtatcggaaggtgcggctggatcacctcctt

SEQ ID NO: 669 - DNA, 1464 bp, Conchiformibius kuhniae
attgaacgctggcggcatgctttacacatgcaagtcggacggcagcrsggaggagcttgcttctykgsyggcgagtggcgaacgggtgagtaacgcattggaacgtaccggatagagggggataacttgccgaaaggtaagctaataccgcatacgccttgagagggaaagcgggggactctttgagcctcgcgctatccgagcggccaatgtctgattagctagttggtggggtaaaagcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtacgggaagaaaagggtggtgctaatatcgctgcctcatgacggtaccgtaagaataagcaccggctaactacgtgccagcagccgcggtaatacgtagggtgcgagcgttaatcggaattactgggcgtaaagcgggcgcagacggttacttaagcaagatgtgaaatccccgagcttaacttgggaactgcgttttgaactgggtagctagagtgtgtcagaggggggtagaattccacgtgtagcagtgaaatgcgtagagatgtggaggaataccgatggcgaaggcagccccctgggataacactgacgttcatgcccgaaagcgtgggtagcaaacaggattagataccctggtagtccacgccctaaacgatgtcgattagctgttggggtacttgataccttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaagagcttagagataggcttgtgccttcgggaaccgtaacacaggtgctgcatggctgtcgtcagctcgtgtcgtgagatgttgggttaagtcccgcaacgagcgcaacccttgtcatcagttgccatcattaagttgggcactctgatgagactgccggtgacaaaccggaggaaggtggggatgacgtcaagtcctcatggcccttatgaccagggcttcacacgtcatacaatggtcggtacaaagggtagccaagccgcgaggcggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaattgggtagggtaaccatttggagcccgcttaacacggtatgcttcatgactggggtg

SEQ ID NO: 670 - DNA, 1486 bp, Coprobacillus cateniformis
agagtttgatcctggctcaggatgaacgctggcggcgtgcctaatacatgcaagtcgaacgcactgattttatcagtgagtggcgaacgggtgagtaatacataagtaacctgccctcatgagggggataactattagaaatgatagctaagaccgcataggtgaaggggtcgcatgaccgcttcattaaatacccgtatggatagcaggaggatggacttatggcgcattagctggttggtgaggtaacggctcaccaaggcgacgatgcgtagccgacctgagagggtggacggccacactgggactgagacacggcccagactctacgggaggcagcagtagggaattttcggcaatgggggaaaccctgaccgagcaacgccccgtgaggcaagaagtatttcggtatgtaaacctctgttataaaggaagaacggtatgaataggaaatgattcataagtgacggtactttatgagaaagccacggctaactacgtgccagcagccgcggtaatacgtaggtggcgaccgttatccggaatcattggccgtaaagagggagcaggcggcaatagaggtctgcggtgaaagcctgaagctaaacttcagtaagccgtggaaaccaaatagctagagtgcagtagaggatcgtggaattccatgtgtagcggtgaaatgcgtagatatatggaggaacaccagtggcgaaggcgacgatctgggctgcaactgacgctcagtcccgaaaccgtggggagcaaataggattagataccctagtagtccaacgccgtaaacgatgagtactaagtgttgggggtcaaacctcagtgctgcagttaacgcaataagtactacgcctgagtagtacgttcgcaagaatgaaactcaaaggaattgacgggggcccgcacaaaaggtggagcatgtggtttaattcgaagcaacgcgaagaaccttaccaggtcttgacatacctctaaaggctctagagatagagagatagctataggggatacaggtggtgcatggttgtcgtcagctcgtgtcgtgagatgttgggttaagtcccgcaacgagcgcaacccttgtcgctagttaccatcattaagttggggactctagcgagactgcctctgcaaggaggaggaaggcggggatgacgtcaaatcatcatgccccttatgacctgggctacacacgtgctacaatggacggatcaaagggaagcgaagccgcgaggtggagcgaaacccaaaaacccgttctcagttcggactgcagtctgcaactcgactgcacgaagttggaatcgctagtaatcgcgaatcagaatgtcgcggtgaatacgttctcgggccttgtacacaccgcccgtcacaccatgagagttggtaacacccgaagccggtggcttaaccgcaaggagagagctgtctaaggtgggactgatgattagggtgaagtcgtaacaaggtaacc

SEQ ID NO: 671 - DNA, 977 bp, Coprobacillus sp.
  29_1
  modified_base (30)..(30): a, c, t, g, unknown or other
attcataagtgacggtactttatgagaaanccacggctaactacgtgccagcagccgcggtaatacgtaggtggcgagcgttatccggaatcattgggcgtaaagagggagcaggcggcaatagaggtctgcggtgaaagcctgaagctaaacttcagtaagccgtggaaaccaaatagctagagtgcagtagaggatcgtggaattccatgtgtagcggtgaaatgcgtagatatatggaggaacaccagtggcgaaggcgacgatctgggctgcaactgacgctcagtcccgaaagcgtggggagcaaataggattagataccctagtagtccacgccgtaaacgatgagtactaagtgttgggggtcaaacctcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatacctctaaaggctctagagatagagagatagctataggggatacaggtggtgcatggttgtcgtcagctcgtgtcgtgagatgttgggttaagtcccgcaacgagcgcaacccttgtcgctagttaccatcattaagttggggactctagcgagactgcctctgcaaggaggaggaaggcggggatgacgtcaaatcatcatgccccttatgacctgggctacacacgtgctacaatggacggatcaaagggaagcgaagccgcgaggtggagcgaaacccaaaaacccgttctcagttcggactgcagtctgcaactcgactgcacgaagttggaatcgctagtaatcgcgaatcagaatgtcgcggtgaatacgttctcgggccttgtacacaccgcccgtcacaccatgagagttggtaacacccgaagccggtggcttaaccgcaaggag

SEQ ID NO: 672 - DNA, 1383 bp, Coprobacillus sp.
  D7
  modified_base (7)..(8): a, c, t, g, unknown or other
cagtcgnncgcgagcacttgtgctcgagtggcgaacgggtgagtaatacataagtaacctgccctagacagggggataactattggaaacgatagctaagaccgcataggtacggacactgcatggtgaccgtattaaaagtgcctcaaagcactggtagaggatggacttatggcgcattagctggttggcggggtaacggcccaccaaggcgacgatgcgtagccgacctgagagggtgaccggccacactgggactgagacacggcccagactcctacgggaggcagcagtagggaattttcggcaatgggggaaaccctgaccgagcaacgccgcgtgaaggaagaaggttttcggattgtaaacttctgttataaaggaagaacggcggctacaggaaatggtagccgagtgaggtactttattagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagctatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaa

SEQ ID NO: 673 - DNA, 989 bp, Coprococcus catus
  modified_base (743)..(743): a, c, t, g, unknown or other
  modified_base (947)..(947): a, c, t, g, unknown or other
  modified_base (965)..(965): a, c, t, g, unknown or other
gatgaagagcttgcttttcaaagttagtggcggacgggtgagtaacgcgtgggtaacctgcctcatacaggggaatagcagctggaaacggctgataaaaccgcataagcgcacagtgccgcatggcacagtgtgaaaaactccggtggtatgagatggacccgcgtctgattagcttgttggcggggtaacggcccaccaaggcgacgatcagtagccggcctgagagggtgatcggccacattgggactgagacacggcccaaactcctacgggaggcagcagtggggaatattgcacaatgggggaaaccctgatgcagcgacgccgcgtgaaggaagaagtatctcggtatgtaaacttctatcagcagggaagataatgacggtacctgactaagaagccccggctaactacgtgccagcagccgcggtaatacgtagggggcaagcgttatccggatttactgggtgtaaagggagcgtaggcggcggagcaagtcagaagtgaaagcccggggctcaaccccgggacggcttttgaaactgccctgcttgatttcaggagaggtaagcggaattcctagtgtagcggtgaaatgcgtagatattaggaggaacaccagtggcgaaggcggcttactggactgacaatgacgctgaggctcgaaagcgtggggagcaaacaggattagataccctggtagtccacgccgtaaacgatgaatactaggtgtcggggcntcataagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaggccttgacatcccggtgaccgacccgtaatggggtcttctctacggagcactggngacaggtggtgcatggtngtcgtcagctcgtgtcgtgagatg

SEQ ID NO: 674 - DNA, 1370 bp, Coprococcus comes
gattcttcggatgaagaggtttgtgactgagtggcggacgggtgagtaacgcgtgggtaacctgcctcatacagggggataacagttagaaatgactgctaataccgcataagaccacggagccgcatggctccgtgggaaaaactccggtggtatgagatggacccgcgtctgattaggtagttggtggggtaacggcctaccaagccaacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcaggaagaaaatgacggtacctgactaagaagcaccggctaaatacgtgccagcagccgcggtaatacgtatggtgcaagcgttatccggatttactgggtgtaaagggagcgtagacggctgtgtaagtctgaagtgaaagcccggggctcaaccccgggactgctttggaaactatgcagctagagtgtcggagaggtaagtggaattcccagtgtagcggtgaaatgcgtagatattgggaggaacaccagtggcgaaggcggcttactggacgatgactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgaccggcgtgtaatgacgccttttcttcggaacaccggtgacaggtggtgcatggttgtcgtcagctcgtgtcgtgagatgttgggttaagtcccgcaacgagcgcaacccttatcttcagtagccagcaattcggatgggcactctggagagactgccagggataacctggaggaaggtggggatgacgtcaaatcatcatgccccttatgagcagggctacacacgtgctacaatggcgtaaacaaagggaagcgagcctgcgagggtaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggtaacgcccgaagtcagtgacccaaccgtaaggagggagctg

SEQ ID NO: 675 - DNA, 1440 bp, Coprococcus eutactus
gatgaacgctggcggcgtgcttaacacatgcaagtcgaacgattgaagctggagcttgctccggccgatttagtggcggacgggtgagtaacgcgtgggtaacctgcctcatacagggggatagcagttggaaacgactggtaaaaccgcataagcgcacrgtatcgcatgatacagtgtgaaaacactccggtggtatgagatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggcaaggcaagtctgaagtgaaaatccggggctcaaccccggaactgctttggaaactgtttagctagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgttgggttccaaagggactcggtgccgtcgcaaacgcattaagtattccacctggggagtacgttcgcaagaatgaaactcaaaggaattgacggggacccgcacaagcggtggagcatgtggtttaattcgaagcaacgcgaaaaaccttaccaagtcttgacatcctgatgacggttccttaaccggaacttctcttcggagcatcagagacaggtggtgcatggttgtcgtcagctcgtgtcgtgagatgttgggttaagtcccgcaacgagcgcaacccctatttccagtagccagcagtaagatgggcactctggagagactgccggggataacccggaggaaggtggggatgacgtcaaatcatcatgccccttatgatttgggctacacacgtgctacaatggcagttacaaagagaagcraacctgtgaaggcgagcaaacctcaaaaaggctgtctcagttcggattgtagtctgcaactcgactacatgaagctggaatcgctagtaatcgcagatcagcatgctgcggtgaatacgttcccgggtcttgtacacaccgcccgtcacaccatgggagtcggtaacgcccgaagtcagtgacccaaccgcaaggagggagctgccgaaggcaggatcgataactggggtg

SEQ ID NO: 676 - DNA, 1440 bp, Coprococcus sp.
  ART55/1
gatgaacgctggcggcgtgcttaacacatgcaagtcgaacgattgaagctggagcttgctccggccgatttagtggcggacgggtgagtaacgcgtgggtaacctgcctcatacagggggatagcagttggaaacgactggtaaaaccgcataagcgcacggtrtcgcatgayacagtgtgaaaacactccggtggtatgagatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggcaaggcaagtctgaagtgaaaatccggggctcaaccccggaactgctttggaaactgtttagctagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgttgggttccaaaggaactcggtgccgtcgcaaacgcattaagtattccacctggggagtacgttcgcaagaatgaaactcaaaggaattgacggggacccgcacaagcggtggagcatgtggtttaattcgaagcaacgcgaaaaaccttaccaagtcttgacatcctgatgacggttccttaaccggaacttttcttcggaacatcagagacaggtggtgcatggttgtcgtcagctcgtgtcgtgagatgttgggttaagtcccgcaacgagcgcaacccctatttccagtagccagcagtaagatgggcactctggagagactgccggggataacccggaggaaggtggggatgacgtcaaatcatcatgccccttatgatttgggctacacacgtgctacaatggcagttacaaagagaagcaaacctgtgaaggcgagcaaacctcaaaaaggctgtctcagttcggattgtagtctgcaactcgactacatgaagctggaatcgctagtaatcgcagatcagcatgctgcggtgaatacgttcccgggtcttgtacacaccgcccgtcacaccatgggagtcggtaacgcccgaagtcagtgacccaaccgcaaggagggagctgccgaaggcaggatcgataactggggtg

SEQ ID NO: 677 - DNA, 1370 bp, Coriobacteriaceae bacterium BV3Ac1
acatgcaagtcgaacgattaaagcaccttcgggtgtgtatagagtggcgaacggctgagtaacacgtgggcaacctgcccttcagttcggaatagctacgggaaaccgtgggtaataccggatgatccacctccctcgcatgaaggaggtggcaaagatttatcgctgaaggatgggcccgcggcctgttagcttgttggtgaggtaacggctcaccaaggcagtaatgggtagccgggttgagagaccgaccggccagattgggactgagacacggcccagactcctacgggaggcagcagtggggaatcttgcgcaatgggcgaaagcctgacgcagcgatgccgcgtgcgggatgaaggccttcgggtcgtaaaccgctttcagcagggacgaggccgcaaggtgacggtacctgcagaagaagccccggctaactacgtgccagcagccgcggtaatacgtagggggcgagcgttatccggattcattgggcgtaaagcgcgcgtaggcggcctgttaggtcaagagttaaatccgggggctcaacccccgtccgctcctgataccggcaggcttgagtctggtaggggaaggcggaattccaagtgtagcggtggaatgcgcagatatttggaagaacaccggtggcgaaggcggccttctgggccacgactgacgctgaggcgcgaaagctaggggagcaaacaggattagataccctggtagtcctagccgtaaacgatggacactaggtgtggggggaacatccctccgtgccgcagctaacgcattaagtgtcccgcctggggagtacggccgcaaggctaaaactcaaaggaattgacgggggcccgcacaagcagcggagcatgtggcttaattcgaagcaacgcgaagaaccttaccagggcttgacatataggtgaagcggtggaaacaccgtagccgaaaggagcctatacaggtggtgcatggctgtcgtcagctcgtgtcgtgagatgttgggttaagtcccgcaacgagcgcaacccccgtcgtatgttgccagcggttcggccgggcacccatacgagaccgccggcgtcaagccggaggaaggtggggacgacgtcaagtcatcatgccccttatgtcctgggctgcacacgtgctacaatggccggcacaatgggctgccaagtcgcaagaccgagcgaatccctaaagccggccccagttcggattggaggctgcaacccgcctccatgaagtcggagttgctagtaatcgcggatcagcacgccgcggtgaatgcgttcccgggccttgtacacaccgcccgtcacaccacccgagtcgtctgcacccgaagtcgccggcccaacctt

SEQ ID NO: 678 - DNA, 1491 bp, Coriobacteriaceae bacterium JC110
agagtttgatcctggctcaggatgaacgctggcggcgtgcctaacacatgcaagtcgaacgatgaaaccgcccccgggcggacatgaagtggcgaacgggtgagtaacacgtgaccgacctgccccccgcccagggacagccccccgaaagggggattaatacctggtactccgggagcggcgcatgccgcccccgggaaagctctcgcggcgggggatggggtcgcggcccatcaggtagacggcggggcagaggcccaccgtgccgacgacgggtagccgggttgagagaccgaccggccacattgggactgagatacggcccagactcctacgggaggcagcagtggggaattttgcgcaatgggggcaaccctgacgcagcaacgccgcgtgcgggacgaaggcgtccgcgtcgtaaaccgctttcagcggggaacacctaacgagggtacccgcagaagaagccccggctaaatacgtgccagcagccgcggtaatacgtatggggcgagcgttatccggattcattgggcgtaaagcgcgcgtaggcggagcgctaagcgggacctctaacccgagggctcaacccccggccgggtcccgaactggcgctctcgagtgcggtaggggagagcggaattcccggtgtagcggtggaatgcgcagatatcgggaagaacaccgacggcgaaggcagctctctgggccgaaactgacgctgaggcgcgaaagctgggggagcgaacaggattagataccctggtagtcccagccgtaaacgatgggcgctaggtgtgggggatgagatcccccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatgcaggtgaagcggcggagacgccgtggccgagaggagcctgcacaggtggtgcatggctgtcgtcagctcgtgtcgtgagatgttgggttaagtcccgcaacgagcgcaacccctgccccgtgttgccagcattcagttggggactcgcgggggactgccggcgtcaagccggaggaaggtggggacgacgtcaagtcatcatgccccttatgccctgggccgcacacgtgctacaatggccggtacagagggttgcgaccccgcgagggggagcggatcccgcaaagccggccccagttcggatcggaggctgcaacccgcctccgtgaagccggagttgctagtaatcgcggatcagcacgccgcggtgaatacgttcccgggccttgtacacaccgcccgtcacaccacccgagtcgtctgcacccgaagccgccggccgaaccctttcaggggcggaggcgtcgaaggtgtggagggtgaggggggtgaagtcgtaacaaggtagccgtaccggaaggtgcggctg

SEQ ID NO: 679 - DNA, 1464 bp, Coriobacteriaceae bacterium phI
gatcctggctcaggatgaacgctggcggcgcgcctaacacatgcaagtcgagcggcaccctgcttcggcaggaagcgagcggcgaacggctgagtaacacgtgaccaacctgccctgcgcacggggacagccgcgggaaaccgcgggtgatacccggtggccccggggggacgcatgtccccagcgggcatagctccggcggcgcgggatggggtcgcggcccatcaggtagttggtagggtgacggcctaccaagccgactacgggtagccgggttgagagaccgaccggccagattgggactgagacacggcccagactcctacgggaggcagcagtggggaatcttgcgcaatggggggaaccctgacgcagcgacgccgcgtgcgggatggaggccttcgggtcgtgaaccgctttcagcagggacgagactgacggtacctgcagaagaagccccggctaactacgtgccagcagccgcggtaatacgtagggggcgagcgttatccggattcattgggcgtaaagcgcgcgtaggcggccgcgcaggcggggggtcaaatcccggggctcaaccccgggccgccccccgaaccgcgcggcttgggtccggcaggggagggtggaacgcccggtgtagcggtggaatgcgcagatatcgggcggaacaccggtggcgaaggcggccctctgggccggcaccgacgctgaggcgcgagagccgggggagcgaacaggattagataccctggtagtcccggccgtaaacgatggacgctaggtgtggggacgttggagtctccgtgtgccgcagccaacgcattaagcgtcccgcctggggagtacggccgcaaggctaaaactcaaaggaattgacgggggcccgcacaagcagcggagcatgtggcttaattcgaagcaacgcgaagaaccttacccgcgcttgacatggcggtgaagcggcggagacgccgtggccgagaggagccgccacaggtggtgcatggctgtcgtcagctcgtgtcgtgagatgttgggttaagtcccgcaacgagcgcaacccccgccgcgtgttgccatcgggtgatgccgggaacccacgcgggaccgccgccgccaaggcggaggagggcggggacgacgtcaagtcatcatgccccttatgcgcggggctgcacacgtgctacaatggcaggtacagagggttgccaccccgcgagggggagcggatcccgaaagcctgccccagttcggaccgggggctgcaacccgcccccgcgaagtcggagttgctagtaatcgcggatcagcatgccgcggtgaatgcgttcccgggccttgtacacaccgcccgtcacaccacccgagtcgtctgcacccgaagccgccggcccaacctcgtgagggaggcgtcgaaggtgtggagggcgaggggggtgaagtcgtaacaaggtagccgta

SEQ ID NO: 680 - DNA, 1497 bp, Gordonibacter pamelaeae
agagtttgatcctggctcaggatgaacgctggcggcgtgcctaacacatgcaagtcgaacgattaagacggctccggccgtgaatagagtggcgaacgggtgagtaacacgtgaccaacctgccccctaccccgggataacgcaaggaaacctgcgctaataccggatactccttcccctgctcctgcaggggtcgggaaagcccagacggtaggggatggggtcgcggcccattaggtagacggcggggcaacggcccaccgtgcctgcgatgggtagccgggttgagagaccgaccggccacattgggactgagatacggcccagactcctacgggaggcagcagtggggaattttgcgcaatggggggaaccctgacgcagcaacgccgcgtgcgggatgaaggccttcgggttgtaaaccgctttcagcagggaagatagtgacggtacctgcagaagaagccccggctaactacgtgccagcagccgcggtaatacgtagggggcgagcgttatccggattcattgggcgtaaagcgcgcgtaggcggcccgtcaagcggaacctctaacccgagggctcaacccccggtcgggttccgaactggcaggctcgagtttggtagaggaagatggaattcccggtgtagcggtggaatgcgcagatatcgggaagaacaccgatggcgaaggcagtcttctgggccatcaactgacgctgaggcgcgaaagctgggggagcgaacaggattagataccctggtagtcccagccgtaaacgatgggtgctaggtgtggggggatcatccctccgtgccgcagccaacgcattaagcaccccgcctggggagtacggccgcaaggctaaaactcaaaggaattgacgggggcccgcacaagcagcggagcatgtggcttaattcgaagcaacgcgaagaaccttaccagggcttgacatgctagtgaagccggggaaacccggtggccgagaggagctagcgcaggtggtgcatggctgtcgtcagctcgtgtcgtgagatgttgggttaagtcccgcaacgagcgcaacccctatcgtatgttgccagcattgagttggggactcatacgagactgccggcgtcaagccggaggaaggtggggacgacgtcaagtcatcatgccctttatgccctgggctgcacacgtgctacaatggccggtacaacgggccgcgacctggcgacaggaagcgaatccctcaaagccggccccagttcggatcggaggctgcaacccgcctccgtgaagtcggagttgctagtaatcgcggatcagcatgccgcggtgaatacgttcccgggccttgtacacaccgcccgtcacaccacccgagtcgtctgcacccgaagccgccggccgaacccgcaaggggcggaggcgtcgaaggtgtggagggtaaggggggtgaagtcgtaacaaggtagccgtaccggaaggtgcggctggatcacct

SEQ ID NO: 681 - DNA, 1522 bp, Corynebacterium accolens
tttttgtggagagtttgatcctggctcaggacgaacgctggcggcgtgcttaacacatgcaagtcgaacggaaaggccctgcttgcagggtactcgagtggcgaacgggtgagtaacacgtgggtgatctgccctgcacttcgggataagcttgggaaactgggtctaataccggataggaaccatctttagtgtggtggttggaaagttttttcggtgtaggatgagctcgcggcctatcagcttgttggtggggtaatggcctaccaaggcggcgacgggtagccggcctgagagggtgtacggccacattgggactgagatacggcccagactcctacgggaggcagcagtggggaatattgcacaatgggcgcaagcctgatgcagcgacgccgcgtgggggatgaaggccttcgggttgtaaactcctttcgctagggacgaagctttttgtgacggtacctagataagaagcaccggctaactacgtgccagcagccgcggtaatacgtagggtgcgagcgttgtccggaattactgggcgtaaagggctcgtaggtggtttgtcgcgtcgtctgtgaaattctggggcttaactccgggcgtgcaggcgatacgggcataacttgagtgctgtaggggtaactggaattcctggtgtagcggtgaaatgcgcagatatcaggaggaacaccgatggcgaaggcaggttactgggcagttactgacgctgaggagcgaaagcatgggtagcgaacaggattagataccctggtagtccatgccgtaaacggtgggcgctaggtgtgagggtctttctacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgctgcagagatgtagtttccctttgtggttggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgctgcgacactgtgaggtggagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggcctaaacgtgttagggagccgtcgaaggtgggatcggcgattgggacgaagtcgtaacaaggtacccgtaccggaaggtgcgggtggatcacctcctttct

SEQ ID NO: 682 - DNA, 1530 bp, Corynebacterium ammoniagenes
tttttgtggagagtttgatcctggctcaggatgaacgctggcggcgtgcttaacacatgcaagtcgaacggaaaggcctgtacttgtacaggtactcgagtggcgaacgggtgagtaacacgtgggtgatctgccctgcactatgggataagcttgggaaactgggtctaataccatataggaccacttcttggatgttgtggtggaaagcttttgcggtgtgggatgagcctgcggcctatcagcttgttggtggggtaatggcctaccaaggcggcgacgggtatccggcctgagagggtgtacggacacattgggactgagatacggcccagactcctacgggaggcagcagtggggaatattgcacaatgggcgcaagcctgatgcagcgacgccgcgtgggggatgacggccttcgggttgtaaactcctttcgctatcgacgaagccaccttgggtggtgacggtaggtagataagaagcaccggctaactacgtgccagcagccgcggtaatacgtagggtgcaagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggattgggctagagatagttcgtcccttgtggtctgtatacaggtggtgcatggttgtcgtcagctcgtgtcgtgagatgttgggttaagtcccgcaacgagcgcaacccttgtcttatgttgccagcacgtgatggtggggactcatgagaaactgccggggttaactcggaggaaggtggggatgacgtcaaatcatcatgccccttatgtccagggcttcacacatgctacaatggtcgatacaatgggcagcgacatcgtgaggtggagcgaatccctgaaagtcggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccagtggcctaaacttgttagggagctgtcgaaggtgggatcggcgattgggacgaagtcgtaacaaggtagccgtaccggaaggtgcggctggatcacctcctttct

SEQ ID NO: 683 - DNA, 1529 bp, Corynebacterium amycolatum
ttttgatggagggtttgatcctggctcaggacgaacgctggcggcgtgcttaacacatgcaagtcgaacggtaaggctccagcttgctggggtacacgagtggcgaacgggtgagtaacacgtgggtgacctgccctgcacttcgggataagcctgggaaactgggtctaataccggataggaccatggtgtggatactgtggtggaaagttttttcggtgtgggatgggcccgcggcctatcagcttgttggtggggtaatggcctaccaaggcggcgacgggtagccggcctgagagggtggacggccacattgggactgagacacggcccagactcctacgggaggcagcagtggggaatattgcacaatgggcgcaagcctgatgcagcgacgccgcgtgggggatgacggccttcgggttgtaaactcctttcaccatcgacgaagggtttctgacggtagatggagaagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtactgtaggggagactggaattcctggtgtagcggtgaaatgcgcagatatcaggaggaacaccggtggcgaaggcgggtctctgggcagtaactgacgctgaggagcgaaagcatggggagcgaacaggattagataccctggtagtccatgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggatcgcgccagagatggtgtttcccttgtggcttgtatacaggtggtgcatggttgtcgtcagctcgtgtcgtgagatgttgggttaagtcccgcaacgagcgcaacccttgtcttatgttgccagcacgtgatggtggggactcgtaagagactgccggggttaactcggaggaaggtggggatgacgtcaaatcatcatgccccttatgtccagggcttcacacatgctacaatggtcggtacagtgggttgccagtccgtgagggcgagctaatcccgtaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaacacttttttgtgggggagctgtcgaaggtgggattggcgattgggacgaagtcgtaacaaggtagccgtaccggaaggtgcggctggatcacctcctttct

SEQ ID NO: 684 - DNA, 1469 bp, Corynebacterium appendicis
cgtgcttaacacatgcaagtcggaacggaaaggcctctgcttgcaggggtactcgagtggcgaacgggtgagtaacacgtgggtgatctgccctgcacttcgggataagcctgggaaactgggtctaataccggataggacgatggtttggatgccattgtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgtcagggacgaagcgaaagtgacggtacctggataagaagcaccggctaactacgtgccagcagccgcggtaatacgtagggtgcgagcgttgtccggaattactgggcgtaaagagctcgtaggtggtttgtcgcgtcgtttgtggaataccgcagcttaactgcggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggaccgggccagagatggtctttcccttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagcgatactgtgaggtggagctaatcgcctaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagcggcccaaacgtgttagggagctgtcgaaggtgggatcggcgattgggacgaagtcgtaacaaggtagccgtaccggaaggtgcggctggatcac

SEQ ID NO: 685 - DNA, 1420 bp, Corynebacterium argentoratense
  modified_base (776)..(776): a, c, t, g, unknown or other
  modified_base (1061)..(1061): a, c, t, g, unknown or other
  modified_base (1365)..(1365): a, c, t, g, unknown or other
cgaacggaaaggcctaagacttgcttgggtactcgagtggcgaacgggcccattaacacgtgagtgatctgccctcaacttcgggataagcctgggaaactgggtctaatactggataggaccatcctttagtgtgtgatggtggaaagttttttcggttggggatgagctcgcggcctatcagcttgttggtggggtaatggcctaccaaggcgtcgacgggtagccggcctgacagggtgtacggccacattgggactgagacacggcccagactcctacaggaggcagcagtggggaatattgcacaatgggcggaagcctgatgcagcgacgccgcgtgagggatgacggccttcgggttgtaaacctctttcgacagggacgaagcttttgtgacggtgacctgtataagaaagcaccggctaactacgtgccaagcagccgcggtaatacgttacgggtgcgagcgttgtccggaattactgggcgtaaagagctcgtagcgtggtttgtcgcgtcgtctgtgaaattccggggcttaactccgggcgtgcaggcgatacgggcataacttgagtgctgtaggggagactggaattcctggtgtaacggtgaaatgcgcatatatcaggaggaacaccgatggcgaaagcaggtctctgggcagtaactgacgctgaggagcgaaagcatggggagcgaacaggattagataccctggtagttcatgccgtaaacggtgggcgctaggtgtaggggacttccacgtcttntgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggatcgctgcagagatgtagtttcccttgtggtctgtatacaggtggtgcatggttgtcgtcagctcgtgtcgtgagatgttgggttaagtcccgcaacgagcgcaacccttgtcttatgttgccagcacactntggtggggactcatgagagactgccggggttaactcggaggaaggtggggatgacgtcaaatcatcatgccccttatgtccagggcttcacacatgctacaatggtcggtacaacgcgctgcgagcctgtgagggtgagcgaatcgctgaaagccggcctcagttcggattggggtctgcaactcgaccccatgaagtcggagtcgctagtaatcgcagatcagcaacgctgcggtgaatacgttcccgggccttgtacacaccgcccgtcaagtcaccgaaagttggtaacacccgaaaaccngtggcctaacccttgtggagggagctgtcgaaggtgggattcggcgattggtcta

SEQ ID NO: 686 - DNA, 1482 bp, Corynebacterium atypicum
gacgaacgctggcggcgtgcttaacacatgcaagtcgtacggaaaggccctgcttttgtggggtgctcgagtggcgaacgggtgagtaacacgtgggtgatctgccctgtacttcgggataagcttgggaaactgggtctaataccggataggactgcgctgtgggtggtgtggtggaaagctttttgcggtatgggatgagctcgcggcctatcagtttgttggtggggtaatggcctaccaaggcgtcgacgggtagccggcctgagagggtgatcggccacattgggactgagatacggcccagactcctgcgggaggcagcagtggggaatattgcacaatgggcgcaagcctgatgcagcgacgccgcgtgggggatgacggccttcgggttgtaaacctctttcgactatgacgaagcctttttggtgacggtagtggtagaagaagcaccggctaactacgtgccagcagccgcggtaatacgtagggtgcgagcgttgtccggatttactgggcgtaaagggctcgtaggtggtttgtcgcgtcgtctgtgaaattccggggcttaacttcgggcgtgcaggcgatacgggcataacttgagtgctgtaggggtaactggaattcctggtgtagcggtggaatgcgcagatatcaggaggaacaccgatggcgaaggcaggttactgggcagttactgacgctgaggagcgaaagcatggggagcgaacaggattagataccctggtagtccatgctgtcaacggtgggcgctaggtgtggggatcttccacggtccctgtgccgtagctaacgttttaagcgccccgcctggggagtacggccgcaaggctaaaactcaaaggaattgacgggggcccgcacaagcggcggagcatgtggattaattcgatgcaacgcgaagaaccttacctgggtttgatatacatcagatcgggccagagatggtctttccctttgtggttggtgtacaggtggtgcatggttgtcgtcagctcgtgtcgtgagatgttgggttaagtcccgcaacgagcgcaacccttgtcttgtgttgccagcatttggttggggactcacgagagactgccggggtgaactcggaggaaggtggggatgacgtcaaatcatcatgccccttatgtccagggcttcacacatgctacaatggtcggtacagtaggttgcgataccgtgaggtggagctaatcctcgtgaaagccggtcgtagttcggattgaggtctgcaactcgacctcatgaagtcggagtcgctagtaatcgcagatcagcagtgctgcggtgaatacgttcccgggccttgtacacaccgcccgtcacgtcatgaaagtcggtaacacccgaagcccacggcctaaccttgttgtaaggggggagtggtcgaaggtgggatcggcgattgggacgaagtcgtaacaaggtagccgtaccggaagg

SEQ ID NO: 687 - DNA, 1522 bp, Corynebacterium aurimucosum
tttttgtggagagtttgatcctggctcaggacgaacgctggcggcgtgcttaacacatgcaagtcgaacggaaaggcctcagcttgctggggtactcgagtggcgaacgggtgagtaacacgtgggtgatctgccttgcactctgggataagcttgggaaactgggtctaataccggatatgaactgcctttagtgtggtggttggaaagttttttcggtgcaagatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgacagggacgaagcgttatgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagttactgacgctgaggagcgaaagcatgggtagcaaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagattgctgcagagatgtagtgtcccttgtggttggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacttgttagggagctgtcgaaggtgggatcggcgattgggacgaagtcgtaacaaggtacccgtaccggaaggtgcgggtggatcacctcctttct

SEQ ID NO: 688 - DNA, 1327 bp, Corynebacterium bovis
gacgaacgctggcggcgtgcttaacacatgcaagtcgaacgagtggcgaacgggtgagtaacacgtgggtgatctgccctgcactctgggataagcctgggaaactgggtctaataccggatagggaaagcggtgcaggatgagcccgcggcctatcagcttgttggtggggtaatggcctaccaaggcggcgacgggtagccggcctgagagggtgtacggccacattgggactgagacacggcccagactcctacgggaggcagcagtggggaatattgcacaatgggcgcaagcctgatgcagcgacgccgcgtgggggatgacggccttcgggttgtaaacccctttcggcagggacgatgacggtacctgcataagaagcaccggctaactacgtgccagcagccgcggtaatacgtagggtgcgagcgttgtccggaattactgggcgtaaagagctcgtaggtggtttgtcgcgtcgtctgtgaaatcccggggcttaactccgggcgtgcaggcgatacgggcaaacttgagtgctgtaggggagactggaattcctggtgtagcggtgaaatgcgcagatatcaggaggaacaccgatggcgaaggcaggtctctgggcagactgacgctgaggagcgaaagcatgggtagcgaacaggattagataccctggtagtccatgccgtaaacggtgggcgctaggtgtggggatttccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcacaggtggtgcatggttgtcgtcagctcgtgtcgtgagatgttgggttaagtcccgcaacgagcgcaacccttgtcttgtgttgccagcacgtggggactcgcgagagactgccggggttaactcggaggaaggtggggatgacgtcaaatcatcatgccccttatgtccagggcttcacacatgctacaatggtcggcagtgggttgcgatgccgcgaggctcagctaatcccttccggtctcagttcggatggagtctgcaactcgactccagaagtcggagtcgctagtaatcgcagatcagcaacgctgcggtgaatacgttcccgggccttgtacacaccgcccgtcacgtcatgaaagttggtaacacccgaagccggtgcccagggagccgtcgaaggtgggatcggcgattgggacgaagtcgtaacaaggtagccgtaccggaagg

SEQ ID NO: 689 - DNA, 1497 bp, Corynebacterium canis
gacgaacgctggcggcgtgcttaacacatgcaagtcgtacggaaaggccctggctttggttggggtgctcgagtggcgaacgggtgagtaacacgtgggtgatctgccctgcactttgggataagcctgggaaactgggtctaatactggataggaccatgcttttgtgtgtcatggtggaaaggcttctgttttgggggctggtgtgggatgagcttgcggcctatcagcttgttggtggggtaatggcctaccaaggcgtcgacgggtagccggcctgagagggtgtacggccacattgggactgagatacggcccagactcctgcgggaggcagcagtggggaatattgcacaatgggcgcaagcctgatgcagcgacgccgcgtgagggatgacggccttcgggttgtaaacctctttcgctggggacgaagcttttttggtgacggtacctggagaagaagcaccggctaactacgtgccagcagccgcggtaatacgtagggtgcgagcgttgtccggaattactgggcgtaaagagctcgtaggtggtttgtcgcgtcgtctgtgaaattccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgggggtcttccacgacttctgtgccgtagctaacgctttaagcgccccgcctggggagtacggccgcaaggctaaaactcaaaggaattgacgggggcccgcacaagcggcggagcatgtggattaattcgatgcaacgcgaagaaccttacctgggcttgacatatgcaggatcgcgccagagatggtgtttcccttgtggcttgtatacaggtggtgcatggttgtcgtcagctcgtgtcgtgagatgttgggttaagtcccgcaacgagcgcaacccttgtcttatgttgccagcacgtgatggtggggactcatgagagactgccggggtcaactcggaggaaggtggggatgacgtcaaatcatcatgccccttatgtccagggcttcacacatgctacaatggtcggtacagtgggttgcgagaccgtgaggtggagcgaatccctttgaaagccggcctcagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagcccatggcctaaccagcgtttgctggggggagtggtcgaaggtgggattggcgattgggacgaagtcgtaacaaggtagccgtaccggaagg

SEQ ID NO: 690 - DNA, 1343 bp, Corynebacterium casei
  modified_base (364)..(364): a, c, t, g, unknown or other
  modified_base (369)..(369): a, c, t, g, unknown or other
  modified_base (409)..(409): a, c, t, g, unknown or other
  modified_base (463)..(463): a, c, t, g, unknown or other
  modified_base (608)..(608): a, c, t, g, unknown or other
aacgggtgagtaacacgtgggtgatctgccctgcactttgggataagcttgggaaactgggtctaataccgaatatgaccacttcttggatgttgtggtggaaagcttttgcggtgtgggatgagcctgcggcctatcagcttgttggtggggtaatggcctaccaaggcggcgacgggtatccggcctgagagggtgtacggacacattgggactgagatacggcccagactcctacgggaggcagcagtggggaatattgcacaatgggcgcaagcctgatgcagcgacgccgcgtgggggatgaaggccttcgggttgtaaactcctttcgctatcgacgaagccacttgtggtgacggtnggtanataagaagcaccggctaactacgtgccagcagccgcggtnatacgtagggtgcaagcgttgtccggaattactgggcgtaaagagctcgtgggnggtttgtcgcgtcgtctgtgaaatcccggggcttaacttcgggcgtgcaggcgatacgggcataacttgagtgctgtaggggagactggaattactggtgttgcggggaaatgcgcatatatcaagacgaacacctatggcgaangcaggtctctgggcagtaactgactctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgtaccggattgggctagagatagtctttcccttgtggtcggtatacaggtggtgcatggttgtcgtcagctcgtgtcgtgagatgttgggttaagtcccgcaacgagcgcaacccttgtcttatgttgccagcacgttatggtgggaactcatgagagactgccggggttaactcggaggaaggtggggatgacgtcaaatcatcatgccccttatgtccagggcttcacacatgctacaatggtcgatacaatgggcagcgacatcgtgaggtgaagcgaatccctgaaagtcggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacttgttagggagctgt

SEQ ID NO: 691 - DNA, 1404 bp, Corynebacterium confusum
gagtttgatcctggctcaggacgaacgctggcggcgtgcttaacacatgcaagtcgaacggaaaggcttcagcttgctggagtactcgagtggcgaacgggtgagtaacacgtgggtgatctgccctgcacttcgggataagcctgggaaactgggtctaataccggataggaccgcactttggtgtgtgtggtggaaagttttttcggtgtaggatgagcccgcggcctatcagcttgttggtggggtaatggcctaccaaggcggcgacgggtagccggcctgagagggtggacggccacattgggactgagatacggcccagactcctacgggaggcagcagtggggaatattgcacaatgggcggaagcctgatgcagcgacgccgcgtgggggatgacggccttcgggttgtaaactcctttcgccagggacgaagcgtttttgtgacggtacctggataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcaggcttgagtactgtaggggtaactggaattcctggtgtagcggtgaaatgcgcagatatcaggaggaacaccgatggcgaaggcaggttactgggcagttactgacgctgaggagcgaaagcatgggtagcgaacaggattagataccctggtagtccatgccgtaaacggtgggcgctaggtgtgagacccttccacgggttttgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatttaggttcgcggcagagatgtcgtttccctttgtggcctttatacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcaatacaatgcgttgcgacactgtgaggtggagctaatcgcttaaagttggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaa

SEQ ID NO: 692 - DNA, 1483 bp, Corynebacterium coyleae
  modified_base (29)..(29): a, c, t, g, unknown or other
  modified_base (51)..(51): a, c, t, g, unknown or other
  modified_base (59)..(59): a, c, t, g, unknown or other
  modified_base (108)..(108): a, c, t, g, unknown or other
  modified_base (362)..(362): a, c, t, g, unknown or other
  modified_base (959)..(959): a, c, t, g, unknown or other
  modified_base (962)..(962): a, c, t, g, unknown or other
atgaacgctggcggcgtgcttaacacatncaagtcgaacggaaaggcctcngcttgcangggtactcgagtggcgaacgggtgagtaacacgtgggtgatctgccccncacttcgggataagcctgggaaactgggtctaataccggataggaccacttcttggaggttgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcancgacgccgcgtgggggatgacggccttcgggttgtaaactcctttcgctagggacgaagcgcaagtgacggtacctagagaagaagcaccggctaactacgtgccagcagccgcggtaatacgtagggtgcgagcgttgtccggaattactgggcgtaaagagctcgtaggtggtttgtcgcgtcgtttgtgtaagcccgcagcttaactgcgggactgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgncgnagagatgcgctttccctttgtggttggtgtacaggtggtgcatggttgtcgtcagctcgtgtcgtgagatgttgggttaagtcccgcaacgagcgcaacccttgtcttatgttgccagcacgtgatggtggggactcatgagagactgccggggttaactcggaggaaggtggggatgacgtcaaatcatcatgccccttatgtccagggcttcacacatgctacaatggtcggtacaacgcgtttgcgagcctgtgagggtgtgctaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtcatgggagctgtcgaaggtgggatcggcgattgggacgaagtcgtaacaaggtagccgtaccggaatgcggctggatcacctcc

SEQ ID NO: 693 - DNA, 1529 bp, Corynebacterium diphtheriae
tttttatggagagtttgatcctggctcaggacgaacgctggcggcgtgcttaacacatgcaagtcgaacggaaaggcctagcttgctaggtactcgagtggcgaacgggtgagtaacacgtgggtgatctgcctcgtacttcgggataagcctgggaaactgggtctaatactggataggaccatgctttagtgtgtgtggtggaaagttttttcggtacgagatgagcccgcggcctatcagcttgttggtggggtaatggcctaccaaggcgtcgacgggtagccggcctgagagggtggacggccacattgggactgagatacggcccagactcctactggaggcagcagtggggaatattgcacaatgggcgcaagcctgatgcagcgacgccgcgtgggggatgacggccttcgggttgtaaacctctttcgctagggacgaagcttttgtgacggtacctagataagaagcaccggctaactacgtgccagcagccgcggtaatacgtagggtgcgagcgttgtccggaattactgggcgtaaagagctcgtaggtggtttgtcgcgtcgtctgtgaaattccggggcttaacttcgggcgtgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagggtcttccacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatgcaggatcggcgtagtgatacgttttcccttgtggtctgtatacaggtggtgcatggttgtcgtcagctcgtgtcgtgagatgttgggttaagtcccgcaacgagcgcaacccttgtcttatgttgccagcacgtgatggtggggactcatgagagactgccggggttaactcggaggaaggtggggatgacgtcaaatcatcatgccccttatgtccagggcttcacacatgctacaatggtcggtacaacgcgctgcgagcctgtgagggtgagcgaatcgctgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaacccttgtggggggagctgtcgaaggtgggatcggcgattgggacgaagtcgtaacaaggtagccgtaccggaaggtgcggctggatcacctcctttctaaggag

SEQ ID NO: 694 - DNA, 1420 bp, Corynebacterium durum
ctcaggacgaacgctggcggcgtgcttaacacatgcaagtcgaacgaaaagccctgccaccttggtggtgggtactcgagtggcgaacgggtgagtaacacgtgggtgatctgccccgcactgtgggataagcctgggaaactgggtctaataccacatacgaccatggcgtaggggtcatggtggaaagccttattgcggtgtgggatgagcccgcggcctatcagcttgttggtggggtaatggcctaccaaggcggcgacgggtagccggcctgagagggtggacggccacattgggactgagacacggcccagactctacgggaggcagcagtggggaatattgcacaatgggcgcaagcctgatgcagcgacgccgcgtgggggatkgaaggcttcgggttgtaaactcctttcgcccgggacgaagcccacctggtgggtgacggtaccgtggagaagaagcaccggctaactacgtgccagcagccgcggtaatacgtagggtgcaagcgttgtccggatttactgggcgtaaagagctcgtaggtggtgtgtcgcgtcgtctgtgaaattccggggcttaactccgggcgtgcaggcgatacgggcacgactagagtgctgtaggggtaactggaattcctggtgtagcggtgaaatgcgcagatatcaggaggaacaccgatggcgaaggcaggttactgggcagttactgacgctgaggagcgaaagcatggggagcgaacaggattagataccctggtagtccatgctgtaaacggtgggcgctaggtgtgggctgtgtgtttgcagtctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatgcaccagatcggcgtagagatacgtcctcccttgtggttggtgcacaggtggtgcatggttgtcgtcagctcgtgtcgtgagatgttgggttaagtcccgcaacgagcgcaacccttgtcttatgttgccagcacatttttggtggggactcatgagaaactgccggggtcaactcggaggaaggtggggatgacgtcaaatcatcatgccctttatacccagggcttcacacatgctacaatggtcggtacaacgggttgcgacactgtgaagtgaagctaatctctgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcctaacca

SEQ ID NO: 695 - DNA, 1524 bp, Corynebacterium efficiens
ttttgtggagagtttgatcctggctcaggacgaacgctggcggcgtgcttaacacatgcaagtcgaacgatgaagccctgcttgcagggtggattagtggcgaacgggtgagtaacacgtgggtgatctgccccgcacttcgggataagcctgggaaactgggtctaataccggatacgaccccctggtaggtcagggggtggaaagattttatcggtgtgggatgagcctgcggcctatcagcttgttggtggggtaatggcctaccaaggcgtcgacgggtagccggcctgagagggtgatcggccacattgggactgagacacggcccagactcctacgggaggcagcagtggggaatattgcacaatgggcgcaagcctgatgcagcgacgccgcgtgggggatgacggccttcgggttgtaaactcctttcgacagggacgaagcttttgtgacggtacctgtagaagaagcaccggctaactacgtgccagcagccgcggtaatacgtagggtgcgagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcagatatcaggaggaacaccaatggcgaaggcaggtctctgggcagtaactgacgctgaggagcgaaagcatgggtagcgaacaggattagataccctggtagtccatgccgtaaacggtgggcgctaggtgtaggggacttccacgtcttctgtgccgcagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactagatcgctgcagagatgtagcttcccttgtggctggtgtacaggtggtgcatggttgtcgtcagctcgtgtcgtgagatgttgggttaagtcccgcaacgagcgcaacccttgtcttatgttgccatcacgtgatggtgggcactcatgagagactgccggggttaactcggaggaaggtggggatgacgtcaaatcatcatgccccttatgtccagggcttcacacatgctacaatggtcggtacagcgagttgccacaccgtgaggtggagctaatctctcaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcccaacccgtaagggggggagctgtcgaaggtgggatcggcgattgggacgaagtcgtaacaaggtagccgtaccggaaggtgcggctggatcacctcctttct

SEQ ID NO: 696 - DNA, 1475 bp, Corynebacterium falsenii
cgaacgctggcggcgtgcttaacacatgcaagtcgaacggaaaggcccttgcttgcaggggtactcgagtggcgaacgggtgagtaacacgtgggtgatctgccttgtacttcgggataagcctgggaaactgggtctaataccggataggaccatgctttagtgtgtgtggtggaaagttttttcggtacaagatgagcccgcggcctatcagcttgttggtggggtaatggcctaccaaggcgacgacgggtagccggcctgagagggtgtacggccacattgggactgagacacggcccagactcctacgggaggcagcagtggggaatattgcacaatgggcgcaagcctgatgcagcgacgccgcgtgagggatgacggccttcgggttgtaaacctctttcgctagggaagaagccacttgtggtgacggtacctggataagaagcaccggctaactacgtgccagcagccgcggtaatacgtagggtgcgagcgttgtccggaattactgggcgtaaagagctcgtaggtggtttgtcgcgtcgtctgtgaaatcccggggcttaactccgggcgtgcaggcgatacgggcataactggagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtggggatctttctacgatttccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatgcaggatcgctgcagagatgtagtttcccttgtggtctgtatacaggtggtgcatggttgtcgtcagctcgtgtcgtgagatgttgggttaagtcccgcaacgagcgcaacccttgtcttgtgttgccagcacgttatggtggggactcgcgagagactgccggggttaactcggaggaaggtggggatgacgtcaaatcatcatgccccttatgtccagggcttcacacatgctacaatggtcggtacagagggtcgcgataccgtgaggtggagctaatccctgaaagccggtctcagttcggattggagtctgcaactcgactccatgaagtcggagtcgctagtaatcgcagatcagcaacgctgcggtgaatacgttcccgggccttgtacacaccgcccgtcacgtcatgaaagttggtaacacccgaagccagtggcccaaactcgttagggagctgtcgaaggtgggatcggcgattgggacgaagtcgtaacaaggtagccgtaccggaaggt

SEQ ID NO: 697 - DNA, 1489 bp, Corynebacterium flavescens
atcgtggagagtttgatcctggctcaggacgaacactggcggcgtgcttaacacatgcaagtcgaacggaaagacccctagcttgctgggggtactcgagtggcgaacgggtgagtaacacgtgggtgatctgccctgcacttcgggataagcttgggaaactgggtctaataccggatatgaacggtctttggtgtgattgttggaaagattttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgaaggccttcgggttgtaaactcctttcgctagggacgaagccttttttaaggtgacggtacctggataagaagcaccggctaactacgtgccagcagccgcggtaatacgtagggtgcaagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatgcaggattgggtcagagatggcttgtcccttgtggtctgtatacaggtggtgcatggctgtcgtcagctcgtgtcgtgagatgttgggttaagtcccgcaacgagcgcaacccttgtcttatgttgccagcacgttatggtggggactcatgagagactgccggggttaactcggaggaaggtggggatgacgtcaaatcatcatgccccttatgtccagggcttcacacatgctacaatggtcggtacaatgcgttgcgatactgtgaggtggagcgaatcgtgtaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccagtggcctaaacttgttagggagctgtcgaaggtgggatcggcgattgggacgaagtcgtaacaa

SEQ ID NO: 698 - DNA, 1529 bp, Corynebacterium genitalium
tttttgtggagagtttgatcctggctcaggatgaacgctggcggcgtgcttaacacatgcaagtcgaacggaaaggccgaagcttgcttcggtactcgagtggcgaacgggtgagtaacacgtgggtgatctgccctgcactttgggataagcctgggaaactgggtctaataccagataggaccacgtcttggatggtgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgtcagtgacggtacctggataagaagcaccggctaactacgtgccagcagccgcggtaatacgtagggtgcgagcgttgtccggaattactgggcgtaaagagctcgtaggtggtttgtcgcgtcgtttgtgtaataccgcagcttaactgcggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgctgcagagatgtagcttcccttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagctacttcgtgaggaggcgctaatcgctctaaagccggccttagttcggattggggtctgcaactcgaccccatgaagtcggagtcgctagtaatcgtagatcagcaacgctgcggtgaatacgttcccgggccttgtacacaccgcccgtcacgtcatgaaagttggtaacacccgaagccagtggcccaaacttgttagggagctgtcgaaggtgggatcggcgattgggacgaagtcgtaacaaggtagccgtaccggaaggtgcggctggatcacctcctttctaaggagc

SEQ ID NO: 699 - DNA, 1466 bp, Corynebacterium glaucum
ggcgtgctaacacatgcaagtcgaacggaaaggccgaagcttgctttggtactcgagtggcgaacgggtgagtaacacgtgggtgatctgccctgcactttgggataagcctgggaaactgggtctaataccagataggaccacggtgtggtgatcgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccaaagacgaattttgacggtatttggagaagaagcaccggctaactacgtgccagcagccgcggtaatacgtagggtgcgagcgttgtccggaattactgggcgtaaagagctcgtaggtggtttgtcgcgtcgtttgtggaataccggggcttaacttcggggttgcatacgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgccgcagagatgtggtttcccttgtggttggtgtacaggtggtgcatggttgtcgtcagctcgtgtcgtgagatgttgggttaagtcccgcaacgagcgcaacccttgtcttatgttgccagcatgttgtggtggggactcatgagagactgccggggttaactcggaggaaggtggggatgacgtcaaatcatcatgccccttatgtccagggcttcacacatgctacaatggtcggtacaacgcgcttgcgagcctgtgagggtgagcgaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtcaaaaggagctgtcgaaggtgggatcggcgattgggacgaagtcgtaacaaggtagccgtaccggaaggtgcggctggatcacct

SEQ ID NO: 700 - DNA, 1533 bp, Corynebacterium glucuronolyticum
ttttgttggagagtttgatcctggctcaggatgaacgctggcggcgtgcttaacacatgcaagtcgaacggaaaggctccagcttgctggggtgctcgagtggcgaacgggtgagtaacacgtaagtgatctgccctgcactgggggataagcttgggaaactgggtctaataccctataggaccgcatcgtggttggtgtggtggaaaggtttttctggtgtgggatgagcttgcggcctatcagcttgttggtggggtaatggcctaccaaggcggcgacgggtagccggcctgagagggtgtgcggccacattgggactgagatacggcccagactcctacgggaggcagcagtggggaattttgcacaatgggcggaagcctgatgcagcgacgccgtgtgggggatgaaggccttcgggttgtaaactcctttcgtcagggacgaagtttttttgacggtacctggataagaagcaccggctaactacgtgccagcagccgcggtaatacgtagggtgcgagcgttgtccggatttactgggcgtaaagggctcgtaggtggtgtgtcgcgtcgtctgtgtaatccaggggcttaacttttggttggcaggcgatacgggcattgcttgagtgctgtaggggagactggaattcctggtgtagcggtgaaatgcgcagatatcaggaggaacaccgatggcgaaggcaggtctctgggcagttactgacgctgaggagcgagagcatgggtagcgaacaggattagataccctggtagtctatgctgtaaacggtgggcgctaggtgtgagtcccttccacggggtttgtgccgtagctaacgctttaagcgccccgcctggggagtacggccgcaaggctaaaactcaaaggaattgacgggggcccgcacaagcggcggagcatgtggattaattcgatgcaacgcgaagaaccttacctgggcttgacatatgtgagattgggctagagatagttcgtcccttgtggctcatttacaggtggtgcatggttgtcgtcagctcgtgtcgtgagatgttgggttaagtcccgcaacgagcgcaacccttgtcttatgttgccagcacgttgtggtggggactcgtgagagactgccggggttaactcggaggaaggtggggatgacgtcaaatcatcatgccccttatgtccagggcttcacacatgctacaatggctggtacagtgcgtgtgcgacaccgtgaggtggagctaatcgcgaaagccagtctcagttcggattggggtctgcaactcgaccccatgaagtcggagtcgctagtaatcgcagatcagcagtgctgcggtgaatacgttcccgggccttgtacacaccgcccgtcacgtcatgaaagttggtaacacccgaagcccatggcccaaccggttttccggggggagtggtcgaaggtgggattggcgattgggacgaagtcgtaacaaggtagccgtaccggaaggtgcggctggatcacctcctttctaagg

SEQ ID NO: 701 - DNA, 1525 bp, Corynebacterium glutamicum
tgtggagagtttgatcctggctcaggacgaacgctggcggcgtgcttaacacatgcaagtcgaacgctgaaaccggagcttgctttggtggatgagtggcgaacgggtgagtaacacgtgggtgatctgccctacactttgggataagcctgggaaactgggtctaataccgaatattcacaccaccgtaggggtggtgtggaaagccttgtgcggtgtgggatgagcctgcggcctatcagcttgttggtggggtaatggcctaccaaggcgtcgacgggtagccggcctgagagggtgtacggccacattgggactgagacacggcccagactcctacgggaggcagcagtggggaatattgcacaatgggcgcaagcctgatgcagcgacgccgcgtgggggatgaaggccttcgggttgtaaactcctttcgctagggacgaagccttttaggtgacggtacctggagaagaagcaccggctaactacgtgccagcagccgcggtaatacgtagggtgcgagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcagatatcaggaggaacaccaatggcgaaggcaggtctctgggcagtaactgacgctgaggagcgaaagcatgggtagcgaacaggattagataccctggtagtccatgccgtaaacggtgggcgctaggtgtaggggtcttccacgacttctgtgccgcagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatggaccggatcggcgtagagatacgttttcccttgtggtcggttcacaggtggtgcatggttgtcgtcagctcgtgtcgtgagatgttgggttaagtcccgcaacgagcgcaacccttgtcttatgttgccagcacattgtggtgggtactcatgagagactgccggggttaactcggaggaaggtggggatgacgtcaaatcatcatgccccttatgtccagggcttcacacatgctacaatggtcggtacagcgagttgccacaccgtgaggtggagctaatctcttaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcccaaccttttaggggggagctgtcgaaggtgggatcggcgattgggacgaagtcgtaacaaggtagccgtaccggaaggtgcggctggatcacctcctttct

SEQ ID NO: 702 - DNA, 1489 bp, Corynebacterium hansenii
gctggcggcgtgcttaacacatgcaagtcgaacggtaaggccccagcttgctggggtacacgagtggcgaacgggtgagtaacacgtgggtgacctgccccgcacttcgggataagcctgggaaactgggtctaataccggataggaccgcatcgttgggatgtggtggaaagttttttcggtgtgggatgggcccgcggcctatcagcttgttggtggggtaatggcctaccaaggcggcgacgggtagccggcctgagagggtggacggccacattgggactgagacacggcccagactcctacgggaggcagcagtggggaatattgcacaatgggcggaagcctgatgcagcgacgccgcgtgggggatgacggccttcgggttgtaaactcctttcaccatcgacgaaggttttctgacggtagatggagaagaagcaccggctaactacgtgccagcagccgcggtaatacgtagggtgcgagcgttgtccggaattactgggcgtaaagagctcgtaggtggtttgtcgcgtcgtctgtgaaattccggggctcaactccgggcgtgcaggcgatacgggcataacttgagtactgtaggggagactggaattcctggtgtagcggtgaaatgcgcagatatcaggaggaacaccggtggcgaaggcgggtctctgggcagtaactgacgctgaggagcgaaagcatgggtagcgaacaggattagataccctggtagtccatgccgtaaacggtgggcgctaggtgtaggggtcttccacgacttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgtacgggatcgggccagagatggtctttcccttgtggctcgtatacaggtggtgcatggttgtcgtcagctcgtgtcgtgagatgttgggttaagtcccgcaacgagcgcaacccttgtcttatgttgccagcacgttatggtggggactcgtgagaaactgccggggtcaactcggaggaaggtggggatgacgtcaaatcatcatgccccttatgtccagggcttcacacatgctacaatggtcggtacagtgggttgcgatgccgtgaggcggagctaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcccaaccttttttggggggagctgtcgaaggtgggatcggcgattgggacgaagtcgtaacaaggtagccgtaccggaaggtgcggctggatcacctcctttct

SEQ ID NO: 703 - DNA, 1460 bp, Corynebacterium imitans
aacgctggcggcgtgcttaacacatgcaagtcgaacggaaaggccgaagcttgcttcggtactcgagtggcgaacgggtgagtaacacgtgggtgatctgccctgtacttcgggataagcttgggaaactgggtctaataccggatatgacaatctcttggatggggttgtggaaagcttttgcggtatgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgcaaccgacgaagcttttgtgacggtaggttgagaagaagcaccggctaactacgtgccagcagccgcggtaatacgtagggtgcgagcgttgtccggaattactgggcgtaaagagctcgtaggtggtttgtcgcgtcgtttgtggaataccgcagcttaactgcggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgctgcagagatgtagcttccctttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgtttgcgagctcgtgagggtgggctaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcccaaacgtgttagggagtggtcgaaggtgggatcggcgattgggacgaagtcgtaacaaggtagccgtac

SEQ ID NO: 704 - DNA, 1532 bp, Corynebacterium jeikeium
tttttatggagagtttgatcctggctcaggacgaacgctggcggcgtgcttaacacatgcaagtcgaacggaaaggctccttgcttgcaaggggtactcgagtggcgaacgggtgagtaacacgtgggtgatctgccttgcacttcgggataagcctgggaaactgggtctaataccggataggaccatgctttagtgtgtgtggtggaaagttttttcggtgcaagatgagcccgcggcctatcagcttgttggtggggtaatggcctaccaaggcgacgacgggtagccggcctgagagggtgtacggccacattgggactgagacacggcccagactcctacgggaggcagcagtggggaatattgcacaatgggcgcaagcctgatgcagcgacgccgcgtgggggatgacggccttcgggttgtaaactcctttcgctagggaagaagccactgtgtggtgacggtacctggataagaagcaccggctaactacgtgccagcagccgcggtaatacgtagggtgcgagcgttgtccggaattactgggcgtaaagagctcgtaggtggtttgtcgcgtcgtctgtgaaatcccggggcttaacttcgggcgtgcaggcgatacgggcataactagagtgctgtaggggagactggaattcctggtgtagcggtgaaatgcgcagatatcaggaggaacaccgatggcgaaggcaggtctctgggcagttactgacgctgaggagcgaaagcatgggtagcgaacaggattagataccctggtagtccatgccgtaaacggtgggcgctaggtgtgggggttttatttacgattcccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgctgcagagatgtagtttcccttgtggctggtgtacaggtggtgcatggttgtcgtcagctcgtgtcgtgagatgttgggttaagtcccgcaacgagcgcaacccttgtcttgtgttgccagcacgttatggtggggactcgcgagagactgccggggttaactcggaggaaggtggggatgacgtcaaatcatcatgccccttatgtccagggcttcacacatgctacaatggtcggtacagtgggttgcgataccgtgaggtggagctaatcccttaaagccggtctcagttcggattggagtctgcaactcgactccatgaagtcggagtcgctagtaatcgcagatcagcaacgctgcggtgaatacgttcccgggccttgtacacaccgcccgtcgcgtcatgaaagttggtaacacccgaagccagtggcccaaacttgttagggagctgtcgaaggtgggattggcgattgggacgaagtcgtaacaaggtagccgtaccggaaggtgcggctggatcacctcctttct

SEQ ID NO: 705 - DNA, 1400 bp, Corynebacterium kroppenstedtii
  modified_base (1077)..(1077): a, c, t, g, unknown or other
cctggctcaggacgaacgctggcggcgtgcttaacacatgcaagtcgaacggaaaggccctgcttgcagggtgctcgagtggcgaacgggtgagtaacacgtgggtgatctgccccttactttgggataagcctgggaaactgggtctaatactggataggaccatgctgtaggtggtgtggtggaaagattttttcggtaagggatgagctcgcggcctatcagcttgttggtggggtaatggcctaccaaggcgtcgacgggtagccggcctgagagggtggacggccacattgggactgagatacggcccagattcctacgggaggcagcagtggggaatattgcacaatgggcgcaagcctgatgcagcgacgccgcgtgggggatgacggccttcgggttgtaaactcctttcagccatgacgaagcccttgtggtgacggtagtggtagaagaagcaccggctaactacgtgccagcagccgcggtaatacgtagggtgcgagcgttgtccggaattactgggcgtaaagagctcgtaggtggtctgtcgcgtcatttgtgaaagcccggggcttaactccgggttggcaggtgatacgggcatgactggagtactgtaggggagactggaattcctggtgtagcggtgaaatgcgcagatatcaggaggaacaccggtggcgaaggcgggtctctgggcagtaactgacgctgaggagcgaaagcatgggtagcgaacaggattagataccctggtagtccatgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcactggatgcggccagagatggttgttccctttgtggctggtgtgcaggtggtgcatggttgtcgtcagctcgtgtcgtgagatgttgggttaagtcccgcaacgagcgcaaccnttgtctcgtgttgccagcatttggttggggactcgcgggagactgccggggttaactcggaggaaggtggggatgacgtcaaatcatcatgccccttatgtccagggcttcacacatgctacaatggctggtacagagagttgcgataccgtgaggtggggctaatctcttaaagccagtctcagttcggattggagtctgcaactcgactccatgaagtcggagtcgctagtaatcgcagatcagcaatgctgcggtgaatacgttcccgggccttgtacacaccgcccgtcacgtcatgaaagttggtaacacccgaagcc

SEQ ID NO: 706 - DNA, 1532 bp, Corynebacterium lipophiloflavum
tttttgtggagagtttgatcctggctcaggatgaacgctggcggcgtgcttaacacatgcaagtcgaacggaaaggccacagcttgctgtggtactcgagtggcgaacgggtgagtaacacgtgggtgatctgccctgtacttcgggataagcttgggaaactgggtctaataccggatatgaccactttttggatggggtggtggaaagcttttgcggtatgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgtaagtgacggtacctggataagaagcaccggctaactacgtgccagcagccgcggtaatacgtagggtgcgagcgttgtccggaattactgggcgtaaagagctcgtaggtggtttgtcgcgtcgtttgtgtaagtccacggcttaactgtgggatggcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgggctagagatagtctttcccttgtggctggtgtacaggtggtgcatggttgtcgtcagctcgtgtcgtgagatgttgggttaagtcccgcaacgagcgcaacccttgtcttatgttgccagcacgtgatggtggggactcatgagagactgccggggttaactcggaggaaggtggggatgacgtcaaatcatcatgccccttatgtccagggcttcacacatgctacaatggtcggtacaacgcgtgtgcgacactgtgaggtgaagctaatcgctctaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacgtgttagggagctgtcgaaggtgggatcggcgattgggacgaagtcgtaacaaggtagccgtaccggaaggtgcggctggatcacctcctttctaaggagc

SEQ ID NO: 707 - DNA, 1334 bp, Corynebacterium macginleyi
gagtttgatcmtggctcaggacgaacgctggcggcgtgcttaacacatgcaagtcgaacgagtggcgaacgggtgagtaacacgtgggtgatctgccctgcacttcgggataagcttgggaaactgggtctaataccggatagggaaagtcggtgtaggatgagctcgcggcctatcagcttgttggtggggtaatggcctaccaaggcggcgacgggtagccggcctgagagggtgtacggccacattgggactgagatacggcccagactcctacgggaggcagcagtggggaatattgcacaatgggcgcaagcctgatgcagcgacgccgcgtgggggatgaaggccttcgggttgtaaactcctttcgctagggacgatgacggtacctagataagaagcaccggctaactacgtgccagcagccgcggtaatacgtagggtgcgagcgttgtccggaattactgggcgtaaagggctcgtaggtggtttgtcgcgtcgtctgtgaaattctggggcttaactccgggcgtgcaggcgatacgggcaaacttgagtgctgtaggggtaactggaattcctggtgtagcggtgaaatgcgcagatatcaggaggaacaccgatggcgaaggcaggttactgggcagactgacgctgaggagcgaaagcatgggtagcgaacaggattagataccctggtagtccatgctgtaaacggtgggcgctaggtgtgagggttctcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggtggtgcatggttgtcgtcagctcgtgtcgtgagatgttgggttaagtcccgcaacgagcgcaacccttgtcttatgttgccagcatggggactcatgagagactgccggggttaactcggaggaaggtggggatgacgtcaaatcatcatgccccttatgtccagggcttcacacatgctacaatggtcggcaacgcgttgcgacactgtgaggtggagcgaatcgctgccggtcttagttcggatggggtctgcaactcgaccccagaagtcggagtcgctagtaatcgcagatcagcaatgctgcggtgaatacgttcccgggccttgtacacaccgcccgtcacgtcatgaaagttggtaacacccgaagccggtgcctagggagccgtcgaaggtgggattggcgattgggacgaagtcgtaacaaggtakcc

SEQ ID NO: 708 - DNA, 1336 bp, Corynebacterium mastitidis
gagtttgatcmtggctcaggacgaacgctggcggcgtgcttaacacatgcaagtcgaacgagtggcgaacgggtgagtaacacgtgggtgatctgccctcaacttcgggataagcttgggaaactgggtctaataccggatagggaaagtcggttggggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgaaggccttcgggttgtaaactcctttcgctaccgacgatgacggtaggtggagaagaagcaccggctaactacgtgccagcagccgcggtaatacgtagggtgcgagcgttgtccggatttactgggcgtaaagagctcgtaggtggtttgtcgcgtcgtctgtgaaattccggggcttaacttcgggcgtgcaggcgatacgggcaaacttgagtgctgtaggggtaactggaattcctggtgtagcggtggaatgcgcagatatcaggaggaacaccgatggcgaaggcaggttactgggcagactgacgctgaggagcgaaagcatgggtagcgaacaggattagataccctggtagtccatgctgtaaacggtgggcgctaggtgtgagccggtttgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggtggtgcatggttgtcgtcagctcgtgtcgtgagatgttgggttaagtcccgcaacgagcgcaacccttgtcttatgttgccagcacgtggggactcatgagagactgccggggttaactcggaggaaggtggggatgacgtcaaatcatcatgccccttatgtccagggcttcacacatgctacaatggtcggcagtaggttgcgataccgtgaggtggagctaatcctgttcggccttagttcggatggggtctgcaactcgaccccagaagtcggagtcgctagtaatcgcagatcagcaacgctgcggtgaatacgttcccgggccttgtacacaccgcccgtcacgtcatgaaagttggtaacacccgaaaaccatgcctagggagtggttgaaggtgggattggcgattgggacgaagtcgtaacaaggtakcc

SEQ ID NO: 709 - DNA, 1559 bp, Corynebacterium matruchotii
tttttttggagagtttgatcctggctcaggacgaacgctggcggcgtgcttaacacatgcaagtcgaacggaaaggcccccacttttttggtgggggtgctcgagtggcgaacgggtgagtaacacgtgggtgatctgccctgcacttcgggataagcttgggaaactgggtctaataccggataggaccatggtttagtgtctcatggtggaaagattattgttttggtgcaggatgagctcgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaactcctttcgttagggacgaagccrcacctkttttgggtgtggtgacggtacctttgttaagaagcaccggctaactacgtgccagcagccgcggtaatacgtagggtgcgagcgttgtccggaattactgggcgtaaagagctcgtaggtggtttgttgcgtcgtctgtgaaattccggggcttaacttcggggtggcaggcgatacgggcataactagagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgctgtaaacggtgggcgttaggtgtggggaccggtttggtttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatgcaccagacggttgtagagatacgtacctccctttgtggttggtgtgcaggtggtgcatggttgtcgtcagctcgtgtcgtgagatgttgggttaagtcccgcaacgagcgcaacccttgtcttatgttgccagcactttgggtggggactcatgagagactgccggggttaactcggaggaaggtggggatgacgtcaaatcatcatgccctttatgcccagggcttcacacatgctacaatggttagtacaacgcgctgcaaacctgtgagggtgagcgaatcgctgaaagctaatctcagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagcccatggcctaaccaccgttttttggtggggggagtggtcgaaggtgggattggcgattgggacgaagtcgtaacaaggtagccgtaccggaaggtgcggctggatcacctcctttct

SEQ ID NO: 710 - DNA, 1400 bp, Corynebacterium minutissimum
  modified_base (49)..(52): a, c, t, g, unknown or other
  modified_base (59)..(61): a, c, t, g, unknown or other
  modified_base (188)..(188): a, c, t, g, unknown or other
  modified_base (426)..(427): a, c, t, g, unknown or other
  modified_base (832)..(832): a, c, t, g, unknown or other
  modified_base (884)..(884): a, c, t, g, unknown or other
  modified_base (1395)..(1396): a, c, t, g, unknown or other
acgaacgctggcggcgtgcttaacacatgcaagtcgaacggaaaggccnnnngcttgcnnngggtactcgagtggcgaacgggtgagtaacacgtgggtgatctgccttgcactctgggataagcttgggaaactgggtctaataccggataggaaccgtctttagtgtggtggttggaaagtttttncggtgcaagatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgacagggacgaagcgnnagtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtgaaatgcgcagatatcaggaggaacaccgatggcgaaggcaggtctctgggcagttactgacgctgaggagcgaaagcatgggtagcgaacaggattagataccctggtagtccatgccgtaaacggtgggcgctaggtgtagggggcttccacgtcttctgtgccgtagctaacgcattaagcgcccngcctggggagtacggccgcaaggctaaaactcaaaggaattgacgggggccngcacaagcggcggagcatgtggattaattcgatgcaacgcgaagaaccttacctgggcttgacatacaccagatcgctgcagagatgtagtttcccttgtggttggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagcgacactgtgaggtggagcgaatcgctgaaagccggtcttagttcggattggggtctgcaactcgaccccatgaagtcggagtcgctagtaatcgtagatcagcaatgctgcggtgaatacgttcccgggccttgtacacaccgcccgtcacgtcatgaaagttggtaacacccgaacgcagtggctnnaact

SEQ ID NO: 711 - DNA, 1459 bp, Corynebacterium mucifaciens
  modified_base (354)..(354): a, c, t, g, unknown or other
  modified_base (385)..(385): a, c, t, g, unknown or other
  modified_base (1092)..(1092): a, c, t, g, unknown or other
ggcggcgtgcttaacacatgcaagtcgaacggaaaggcccaagcttgcttgggtactcgagtggcgaacgggtgagtaacacgtgggtgatctgccctgcacttcgggataagcctgggaaactgggtctaataccggataggacgatggtttggatgccattgtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagngacgccgcgtgggggatgacggccttcgggntgtaaactcctttcgctagggacgaagcgttttgtgacggtacctggagaagaagcaccggctaactacgtgccagcagccgcggtaatacgtagggtgcgagcgttgtccggaattactgggcgtaaagagctcgtaggtggtttgtcgcgtcgtttgtgtaagcccgcagcttaactgcgggactgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgccgtagagatacggtttccctttgtggttggtgtacaggtggtgcatggttgtcgtcagctcgtgtcgtgagatgttgggttaagtcccgcaacgagcgcaacccttgtcttatgttgccagcagctgatggtggggactcntgagagactgccggggttaactcggaggaaggtggggatgacgtcaaatcatcatgccccttatgtccagggcttcacacatgctacaatggtcggtacaacgcgcatgcgagcctgtgaggtggagcgaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacagtcatgaaagttggtaacacccgaagccagtggcctgttacagggagctgtgtcgaaggtgggatcggcgattgggacgaagtcgtaacaaggtagccgtaccgg

SEQ ID NO: 712 - DNA, 1443 bp, Corynebacterium propinquum
  modified_base (16)..(16): a, c, t, g, unknown or other
ctgctcaggacgaacnctggcggcgtgcttaacacatgcaagtcgaacggaaaggccttttcggaggtactcgagtggcgaacgggtgagtaacacgtgggtgatctgccctgcactctgggataagcctgggaaactgggtctaataccggataggactgcactttagtgtgtgtggtggaaagttttttcggtgtaggatgagcccgcggcctatcagcttgttggtggggtaatggcctaccaaggcggcgacgggtagccggactgagaggttggtcggccacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgttttgtgacggtacctggagaagaagcaccggctaactacgtgccagcagccgcggtaatacgtagggtgcaagcgttgtccggaattactgggcgtaaagagctcgtaggtggtttgtcgcgtcgtctgtgaaattccacagcttaactgtgggcgtgcaggcgatacgggctgacttgagtactgtaggggtaactggaattcctggtgtagcggtgaaatgcgcagatatcaggaggaacaccgatggcgaaggcaggttactgggcagttactgacgctgaggagcgaaagcatgggtagcaaacaggattagataccctggtagtccatgccgtaaacggtgggcgctaggtgtaggggccttttggggtttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgctgcagagatgtagtttcccttgtggctggtgtacaggtggtgcatggctgtcgtcagctcgtgtcgtgagatgttgggttaagtcccgcaacgagcgcaacccttgtcttatgttgccagcacgttatggtggggactcatgagagactgccggggttaactcggaggaaggtggggacgacgtcaagtcatcatgccccttatgtccagggcttcacacatgctacaatggccggtacaatgcgcagcgagcctgtgagggtgagctaatcgcttaaagccggtcttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggctcaaactcggtttagggagccgtcgaaggtgggatcggcgattgg

SEQ ID NO: 713 - DNA, 1483 bp, Corynebacterium pseudodiphtheriticum
cctggctcaggacgaacgctggcggcgtgcttaacacatgcaagtcgaacggaaaggcctcttcggaggtactcgagtggcgaacgggtgagtaacacgtgggtgatctgccctgcactctgggataagcctgggaaactgggtctaataccggataggaccatgctttagtgtgtgtggtggaaagttttttcggtgtaggatgagcccgcggcctatcagcttgttggtggggtaatggcctaccaaggcggcgacgggtagccggactgagaggttggtcggccacattgggactgagatacggcccagactcctacgggaggcagcagtggggaatattgcacaatgggcgcaagcctgatgcagcgacgccgcgtgggggatgacggccttcgggttgtaaactcctttcggcagggacgaagcgttttgtgacggtacctggagaagaagcaccggctaactacgtgccagcagccgcggtaatacgtagggtgcaagcgttgtccggaattactgggcgtaaagagctcgtaggtggtttgtcacgtcgtctgtgaaattccacagcttaactgtgggcgtgcaggcgatacgggctgacttgagtactgtaggggtaactggaattcctggtgtagcggtgaaatgcgcagatatcaggaggaacaccgatggcgaaggcaggttactgggcagttactgacgctgaggagcgaaagcatgggtagcaaacaggattagataccctggtagtccatgccgtaaacggtgggcgctaggtgtagggaccttttggggtttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactggatcgctgcagagatgtagtttcccttgtggctagtgtacaggtggtgcatggctgtcgtcagctcgtgtcgtgagatgttgggttaagtcccgcaacgagcgcaacccttgtcttatgttgccagcacgttatggtggggactcatgagagactgccggggttaactcggaggaaggtggggacgacgtcaagtcatcatgccccttatgtccagggcttcacacatgctacaatggccggtacaatgcgcagcgagcctgtgagggtgagctaatcgcttaaagctggtcttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggctcaaactcgtttagggagccgtcgaaggtgggatcggcgattgggacgaagtcgtaacaaggtagccgtaccggaaggtgcgg

SEQ ID NO: 714 - DNA, 1529 bp, Corynebacterium pseudogenitalium
tttttgtggagagtttgatcctggctcaggacgaacgctggcggcgtgcttaacacatgcaagtcgaacggaaaggccctgcttgcagggtactcgagtggcgaacgggtgagtaacacgtgggtgatctgccctgcacttcgggataagcctgggaaactgggtctaataccggataggagccatttttagtgtgatggttggaaagttttttcggtgtaggatgagctcgcggcctatcagcttgttggtggggtaatggcctaccaaggcggcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaactcctttcgctagggacgaagctttttgtgacggtacctagataagaagcaccggctaactacgtgccagcagccgcggtaatacgtagggtgcgagcgttgtccggaattactgggcgtaaagggctcgtaggtggtttgtcgcgtcgtctgtgaaattccggggcttaactccgggcgtgcaggcgatacgggcataacttgagtactgtaggggtaactggaattcctggtgtagcggtgaaatgcgcagatatcaggaggaacaccgatggcgaaggcaggttactgggcagttactgacgctgaggagcgaaagcatgggtagcgaacaggattagataccctggtagtccatgccgtaaacggtgggcgctaggtgtgagggtcttttcacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactggatcgggctagagatagtctttccctttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggcccaaacttgttagggagccgtcgaaggtgggatcggcgattgggacgaagtcgtaacaaggtacccgtaccggaaggtgcgggtggatcacctcctttctaaggagc

SEQ ID NO: 715 - DNA, 1396 bp, Corynebacterium pseudotuberculosis
  modified_base (827)..(827): a, c, t, g, unknown or other
  modified_base (879)..(879): a, c, t, g, unknown or other
acgaacgctggcggcgtgcttaacacatgcaagtcgaacggaaaggccccttcgggggtgctcgagtggcgaacgggtgagtaacacgtgggtgatctgcctcgtactctgggataagcctgggaaactgggtctaatactggataggaccgcactttagtgtgtgtggtggaaagttttttcggtacgagatgagcccgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgagggatgacggccttcgggttgtaaacctctttcgacagggacgaagctttttgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagggtcttccacgactttcgtgccgtagctaacgcattaagcgcccngcctggggagtacggccgcaaggctaaaactcaaaggaattgacgggggccngcacaagcggcggagcatgtggattaattcgatgcaacgcgaagaaccttacctgggcttgacatatacaagatcggcgtagagatacgttttcccttgtggtttgtatacaggtggtgcatggttgtcgtcagctcgtgtcgtgagatgttgggttaagtcccgcaacgagcgcaacccttgtcttatgttgccagcacgtgatggtggggactcatgagagactgccggggttaactcggaggaaggtggggatgacgtcaaatcatcatgccccttatgtccagggcttcacacatgctacaatggtcggtacaacgcgttgcgagcctgtgagggtgagcgaatcgctgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaacgccatggcccaacc

SEQ ID NO: 716 - DNA, 1409 bp, Corynebacterium pyruviciproducens
acgctggcggcgtgcttaacacatgcaagtcgaacggaaaggcctcagcttgctggggtgctcgagtggcgaacgggtgagtaacacgtaggtgatctgcctttcacttcgggataagcttgggaaactgggtctaataccggatattcactatgccgtggttggtgtggtggaaagcttttgcggtgggagatgagcttgcggcctatcagcttgttggtggggtaatggcctaccaaggcggcgacgggtagccggcctgagagggtgtgcggccacattgggactgagatacggcccagactcctacgggaggcagcagtggggaattttgcacaatgggcggaagcctgatgcagcgacgccgtgtgggggatgaaggccttcgggttgtaaactcctttcgtcagggacgaagtttgtttgacggtacctggataagaagcaccggctaactacgtgccagcagccgcggtaatacgtagggtgcgagcgttgtccggatttactgggcgtaaagggctcgtaggtggtgtgttgcgtcgtctgtgtaatccaggggcttaacttttggttggcaggcgatacgggcattgcttgagtgctgtaggggagactggaattcctggtgtagcggtgaaatgcgcagatatcaggaggaacaccgatggcgaaggcaggtctctgggcagttactgacgctgaggagcgagagcatgggtagcgaacaggattagataccctggtagtctatgctgtaaacggtgggcgctaggtgtgagcctcttccacggggtttgtgccgtagctaacgctttaagcgccccgcctggggagtacggccgcaaggctaaaactcaaaggaattgacgggggcccgcacaagcggcggagcatgtggattaattcgatgcaacgcgaagaaccttacctgggcttgacataggcaggatgggcgcagagatgtgtcgtccctttgtggtctgtttacaggtggtgcatggttgtcgtcagctcgtgtcgtgagatgttgggttaagtcccgcaacgagcgcaacccttgtcttatgttgccagcacgttgtggtggggactcgtgagagactgccggggttaactcggaggaaggtggggatgacgtcaaatcatcatgccccttatgtccagggcttcacacatgctacaatggttggtacagtgcgtgagcaacatcgtgaggtggagctaatcgctaaagccagtctcagttcggattggggtctgcaactcgacctcatgaagtcggagtcgctagtaatcgcagatcagcagtgctgcggtgaatacgttcccgggccttgtacacaccgcccgtcacgtcatgaaagttggtaacacccgaagcccatggcctaaccggttttgccggg

SEQ ID NO: 717 - DNA, 1395 bp, Corynebacterium renale
  modified_base (830)..(830): a, c, t, g, unknown or other
  modified_base (882)..(882): a, c, t, g, unknown or other
  modified_base (1391)..(1391): a, c, t, g, unknown or other
acgaacgctggcggcgtgcttaacacatgcaagtcgaacggaaaggccactgcttgcagtggtactcgagtggcgaacgggtgagtaacacgtgggtgatctgccctgtactttgggataagcctgggaaactgggtctaataccggataggaccatcgtttagtgtcggtggtggaaagcttttgcggtacgggatgagctcgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgagggatgacggccttcgggttgtaaacctctttcgctagggacgaagcttttgtgacggtacctagagaagaagcaccggctaactacgtgccagcagccgcggtaatacgtagggtgcgagcgttgtccggatttactgggcgtaaagagctcgtaggtggtttgtcgcgtcgtctgtgaaattccggggcttaactccgggcgtgcaggcgatacgggcataacttgagtactgtaggggagactggaattcctggtgtagcggtggaatgcgcagatatcaggaggaacaccgatggcgaaggcaggtctctgggcagttactgacactgaggagcgaaagcatgggtagcgaacaggattagataccctggtagtccatgccgtaaacggtgggcgctaggtgtgagacccttccacgggttttgtgccgtagctaacgcattaagcgcccngcctggggagtacggccgcaaggctaaaactcaaaggaattgacgggggccngcacaagcggcggagcatgtggattaattcgatgcaacgcgaagaaccttacctgggtttgacatacaccagaccgggccagagatggtctttccctttgtggttggtgtacaggtggtgcatggttgtcgtcagctcgtgtcgtgagatgttgggttaagtcccgtaacgagcgcaacccttgtcttatgttgccagcacgttgtggtggggactcatgagagactgccggggttaactcggaggaaggtggggatgacgtcaaatcatcatgccccttatgtccagggcttcacacatgctacaatggtcggtacaacgcgtgtgctacttcgtgaggagatgctaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaacgccntggc

SEQ ID NO: 718 - DNA, 1320 bp, Corynebacterium resistens
aaagttttttcggtacgagatgagcccgcggcctatcagcttgttggtggggtaatggcctaccaaggcgacgacgggtagccggcctgagagggtgtacggccacattgggactgagacacggcccagactcctacgggaggcagcagtggggaatattgcacaatgggcggaagcctgatgcagcgacgccgcgtgagggatgacggccttcgggttgtaaacctctttcgctagggaagaagcctttttggtgacggtacctggataagaagcaccggctaactacgtgccagcagccgcggtaatacgtagggtgcaagcgttgtccggaattactgggcgtaaagagctcgtaggtggtttgtcgcgtcgttagtgaaagcccggggcttaactccgggtctgctggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgggggtttttcacgacttccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacgggatcggcgtagagatacgttttcccttgtggctcgtatacaggtggtgcatggttgtcgtcagctcgtgtcgtgagatgttgggttaagtcccgcaacgagcgcaacccttgtcttgtgttgccagcacgttatggtggggactcgcgagagactgccggggttaactcggaggaaggtggggatgacgtcaaatcatcatgccccttatgtccagggcttcacacatgctacaatggtcggtacagtgggttgcgatgccgtgaggtggagctaatcccttaaagccggtctcagttcggattggagtctgcaactcgactccatgaagtcggagtcgctagtaatcgcagatcagcaacgctgcggtgaatacgttcccgggccttgtacacaccgcccgtcacgtcatgaaagttggtaacacccgaagccagtggcccaaactcgttagggagctgtcgaaggtgggatcggcgattgggacgaagtcgtaacaaggtagccgtaccggaaggtgcggctggatcacctcctttct

SEQ ID NO: 719 - DNA, 1457 bp, Corynebacterium riegelii
atgaacgctggcggcgtgcttaacacatgcaagtcgaacggaaaggcccaagcttgcttgggtactcgagtggcgaacgggtgagtaacacgtgggtgatctgccctgcacttcgggataagcctgggaaactgggtctaataccggataggaccacttcgtagktgttgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgccaaagacgaattttgacggtatttggagaagaagcaccggctaactacgtgccagcagccgcggtaatacgtagggtgcgagcgttgtccggaattactgggcgtaaagagctcgtaggtggtttgtcgcgtcgtttgtggaagtccacggcttaactgtgggactgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgctgcagagatgtagtttcccttgtggctggtgtacaggtggtgcatggttgtcgtcagctcgtgtcgtgagatgttgggttaagtcccgcaacgagcgcaacccttgtcttatgttgccagcacgtgatggtggggacttatgagaaactgccggggttaactcggaggaaggtggggatgacgtcaaatcatcatgccccttatgtccagggcttcacacatgctacaatggtcggtacaacgcgcagctacctcgtgaggggacgcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtcaaaaggagctgtcgaaggtgggatcggcgattgggacaagtcgtaacaaggtagccgtaccgg

SEQ ID NO: 720 - DNA, 1469 bp, Corynebacterium simulans
gacgaacgctggcggcgtgcttaacacatgcaagtcgaacggaaaggcctcagcttgctggggtactcgagtggcgaacgggtgagtaacacgtgggtgatctgccttgcacttcgggataagcttgggaaactgggtctaataccggataggacagctgtttagtgtcagttgtggaaagttttttcggtgcaagatgagctcgcggcctatcagcttgttggtggggtaatggcctaccaaggcgtcgacgggtagccggcctgagagggtggacggccacattgggactgagatacggcccagactcctacgggaggcagcagtggggaatattgcacaatgggcggaagcctgatgcagcgacgccgcgtgggggatgaaggccttcgggttgtaaactcctttcgacagggacgaagcttttgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggctgacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatagcggatcgctgcagagatgtagtttccctttgtggtcgttatacaggtggtgcatggttgtcgtcagctcgtgtcgtgagatgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggctcaaactcgttagggagctgtcgaaggtgggatcggcgattgggacgaagtcgtaacaaggtagccgtaccggaagg

SEQ ID NO: 721 - DNA, 1323 bp, Corynebacterium singulare
  modified_base (922)..(922): a, c, t, g, unknown or other
  modified_base (1086)..(1086): a, c, t, g, unknown or other
acgaacgctggcggcgtgcttaacacatgcaagtcgaacggaaaggccctagcttgctgaggtgctcgagtggcgaacgggtgagtaacacgtgggtgatctgccttgtactctgggataagcttgggaaactgggtctaataccggataggaactgcctttagtgtggtggttggaaagttttttcggtgcaagatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgacagggacgaagctttttgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtgaaatgcgcagatatcaggaggaacaccgatggcgaaggcaggtctctgggcagttactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacncgaagaaccttacctgggcttgacatacaccagatcgctgcagagatgtagtttcccttgtggttggtgtacaggtggtgcatggttgtcgtcagctcgtgtcgtgagatgttgggttaagtcccgcaacgagcgcaacccttgtcttatgttgccagcatttngttggggactcatgagagactgccggggttaactcggaggaaggtggggatgacgtcaaatcatcatgccccttatgtccagggcttcacacatgctacaatggtcggtacaacgcgcagcgacactgtgaggtggagcgaatcgctgaaagccggtcttagttcggattggggtctgcaactcgaccccatgaagtcggagtcgctagtaatcgtagatcagcaatgctgcggtga

SEQ ID NO: 722 - DNA, 1475 bp, Corynebacterium sp.
  1 ex sheep
gacgaacgctggcggcgtgcttaacacatgcaagtcgaacggaaaggcccctagcttgctgggggtactcgagtggcgaacgggtgagtaacacgtgggtgatctgccctgcacttcgggataagcctgggaaactgggtctaataccggataggagccatctttggtgtgatggttggaaagttttttcggtgtaggatgagcctgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgttttgtgacggtacctggataagaagcaccggctaactacgtgccagcagccgcggtaatacgtagggtgcgagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgtaccagatcgccatagagatatggtttcccttgtggctggttcacaggtggtgcatggttgtcgtcagctcgtgtcgtgagatgttgggttaagtcccgcaacgagcgcaacccttatcttatgttgccagcacgtagtggtggggactcatgagagactgccggggtcaactcggaggaaggtggggatgacgtcaaatcatcatgccccttatgtccagggcttcacacatgctacaatggtcggtacaacgcgcagcgagactgtgaggttaagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccagtggcccaaactcgtttagggagctgtcgaaggtgggatcggcgattgggacgaagtcgtaacaaggtagccgtaccggaagg

SEQ ID NO: 723 - DNA, 1491 bp, Corynebacterium sp.
  L-2012475
gaacgctggcggcgtgcttaacacatgcaagtcgaacggaaaggctcaagcttgcttgggtactcgagtggcgaacgggtgagtaacacgtgggtgatctgccctgcactttgggataagcctgggaaactgggtctaataccggataggaccatcgtttagtgtcggtggtggaaagtttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccaaggacgaagaggaattgacggtacttggataagaagcaccggctaactacgtgccagcagccgcggtaatacgtagggtgcgagcgttgtccggaattactgggcgtaaagagctcgtaggtggtttgtcgcgtcgtttgtggaataccgcagcttaactgtggggttgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgggctagagatagtctttcccttgtggctggtgtacaggtggtgcatggttgtcgtcagctcgtgtcgtgagatgttgggttaagtcccgcaacgagcgcaacccttgtcttatgttgccagcacgtgatggtggggactcatgagagactgccggggttaactcggaggaaggtggggatgacgtcaaatcatcatgccccttatgtccagggcttcacacatgctacaatggtcggtacaacgcgcagcttccctgtgagggggtgcgaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcccaaacgtgttagggagctgtcgaaggtgggatcggcgattgggacgaagtcgtaacaaggtagccgtaccggaaggtgcggctggatcaccttctttcta

SEQ ID NO: 724 - DNA, 1445 bp, Corynebacterium sp.
  NML 93-0481
catgcaagtcgaacggaaaggctccagcttgctggggtactcgagtggcgaacgggtgagtaacacgtgggtgatctgccctgcacttcgggataagcctgggaaactgggtctaataccggataggaccacttctttgaggttgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgtcagggacgaagcgaaagtgacggtacctggataagaagcaccggctaactacgtgccagcagccgcggtaatacgtagggtgcgagcgttgtccggaattactgggcgtaaagagctcgtaggtggtttgtcgcgtcgtttgtggaataccgcagcttaactgtggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggaccgggccagagatggtctttcccttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgttgctacttcgtgaggagatgctaatcgctaaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaactcgttagggagctgtcgaaggtgggatcggcgattgggacgaagtcgtaacaaggtagccgtaccggaaggtg

SEQ ID NO: 725 - DNA, 1457 bp, Corynebacterium sp.
  NML 97-0186
catgcaagtcgaacggaaaggccagtgcttgcactggtactcgagtggcgaacgggtgagtaacacgtgggtgatctgccctcaactccgggataagcctgggaaactgggtctaatactggataggaccacatcgtaggtggtgtggtggaaagcgtttgtagcggttggggatgagctcgcggcctatcagcttgttggtggggtaatggcctaccaaggcggcgacgggtagccggcctgagagggtgtacggtcacattgggactgagatacggcccagactcctacgggaggcagcagtggggaatattgcacaatgggcgcaagcctgatgcagcgacgccgcgtgggggatgacggccttcgggttgtaaacctctttcgaccgtgacgaagcctttggtgacggtagcggtagaagaagcaccggctaactacgtgccagcagccgcggtaatacgtagggtgcgagcgttgtccggatttactgggcgtaaagggctcgtaggtggtttgtcgcgtcgtctgtgaaattccggggctcaactccgggcgtgcaggcgatacgggcataacttgagtactgcaggggtaactggaattcctggtgtagcggtggaatgcgcagatatcaggaggaacaccgatggcgaaggcaggttactgggcagttactgacgctgaggagcgaaagcatgggtagcgaacaggattagataccctggtagtccatgctgtcaacggtgggcgctaggtgtgagacccttccacgggttttgtgccgtagctaacgttttaagcgccccgcctggggagtacggccgcaaggctaaaactcaaaggaattgacgggggcccgcacaagcggcggagcatgtggattaattcgatgcaacgcgaagaaccttacctgggtttgacatacactggatcgcctcggagacggggtttccctttgtggtcggtgtacaggtggtgcatggttgtcgtcagctcgtgtcgtgagatgttgggttaagtcccgcaacgagcgcaacccttgtcctgtgttgccagcacgttgtggtggggactcacgggagactgccggggtgaactcggaggaaggtggggatgacgtcaaatcatcatgccccttatgtccagggcttcacacatgctacaatggtcggtacaacaggttgcgataccgtgaggtggagctaatccttttaaagccggcctcagttcggattggggtctgcaactcgaccccatgaagtcggagtcgctagtaatcgcagatcagcagtgctgcggtgaatacgttcccgggccttgtacacaccgcccgtcacgtcatgaaagtcggtaacacccgaagcccacggcccaacccttgtggggggagtggtcgaaggtgggatcggcgattgggacgaagtcgtaacaaggtagccgtaccggaaggtgcg

SEQ ID NO: 726 - DNA, 1453 bp, Corynebacterium sp.
  NML 99-0018
catgcaagtcgaacggaaaggcctctagcttgctaggggtactcgagtggcgaacgggtgagtaacacgtgggtgatctgccctgcactttgggataagcttgggaaactgggtctaataccgaatatgaccattgtttggatgcgatggtggaaagcttttgcggtgtgggatgagcctgcggcctatcagcttgttggtggggtaatggcctaccaaggcggcgacgggtatccggcctgagagggtgtacggacacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgtttttgtgacggtacctggataaraagcaccggctaactacgtgccagcagccgcggtaatacgtagggtgcgagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcaratatcaggaggaacaccgatggcgaaggcaggtctctgggcagtaactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgtacaggatcgggctagagatagtctttcccttgtggtctgtatacaggtggtgcatggttgtcgtcagctcgtgtcgtgagatgttgggttaagtcccgcaacgagcgcaayccttgtcttatgttgccagcacgttatggtggggactcatgagagactgccggggttaactcggaggaaggtggggatgacgtcaaatcatcatgccccttatgtccagggcttcacacatgctacaatggtcgatacagtgggcagcgacatcgtgaggtggagcgaatccctgaaagtcggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacttgttagggagctgtcgaaggtgggatcggcgattgggacgaagtcgtaacaaggtagccgtaccggaaggtgcg

SEQ ID NO: 727 - DNA, 1522 bp, Corynebacterium striatum
tttttgtggagagtttgatcctggctcaggacgaacgctggcggcgtgcttaacacatgcaagtcgaacggaaaggcctgcagcttgctgcgggtactcgagtggcgaacgggtgagtaacacgtgggtgatctgccttgcacttcgggataagcttgggaaactgggtctaataccggataggacagctgtttagtgtcagttgtggaaagttttttcggtgcaagatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgaaggccttcgggttgtaaactcctttcgacagggacgaagcgtaagtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggctgacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaagacaggcgtagagatacgtcctcccttgtggtttgtatacaggtggtgcatggttgtcgtcagctcgtgtcgtgagatgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggctcaaactcgttagggagctgtcgaaggtgggatcggcgattgggacgaagtcgtaacaaggtagccgtaccggaaggtgcggctggatcacctcctttct

SEQ ID NO: 728 - DNA, 1468 bp, Corynebacterium sundsvallense
gatgaacgctggcggcgtgcttaacacatgcaagtcgaacggaaaggccagtgcttgcactggtgctcgagtggcgaacgggtgagtaacacgtgagtgatctgccctgcactttgggataagcctgggaaactgggtctaataccggataggaccatgctttagatggtgtggtggaaagttttttcggtgtgggatgagcttgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgcaactgacgaagctttgtgtgacggtaggttgagaagaagcaccggctaactacgtgccagcagccgcggtaatacgtagggtgcgagcgttgtccggaattactgggcgtaaagagctcgtaggtggtttgtcgcgtcgtgtgtgaaattccggggcttaacttcggggttgcatacgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgaggcccttccacgggtttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccgaatcgctgcagagatgtggtttcccttgtggttggtgtacaggtggtgcatggttgtcgtcagctcgtgtcgtgagatgttgggttaagtcccgcaacgagcgcaacccttgtcttatgttgccagcatgttgtggtgggcacttatgagagactgccggggttaactcggaggaaggtggggatgacgtcaaatcatcatgccccttatgtccagggcttcacacatgctacaatggtcggtacaacgcgcagctacctcgtgaggggacgcgaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtgaaaaggagctgtcgaaggtgggatcggcgattgggacgaagtcgtaacaaggtagccgtaccggaagg

SEQ ID NO: 729 - DNA, 1522 bp, Corynebacterium tuberculostearicum
tttttgtggagagtttgatcctggctcaggacgaacgctggcggcgtgcttaacacatgcaagtcgaacggaaaggccctgcttgcagggtactcgagtggcgaacgggtgagtaacacgtgggtgatctgccctgcacttcgggataagcctgggaaactgggtctaataccggataggagccatttttagtgtgatggttggaaagttttttcggtgtaggatgagctcgcggcctatcagcttgttggtggggtaatggcctaccaaggcggcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaactcctttcgctagggacgaagctttttgtgacggtacctagataagaagcaccggctaactacgtgccagcagccgcggtaatacgtagggtgcgagcgttgtccggaattactgggcgtaaagggctcgtaggtggtttgtcgcgtcgtctgtgaaattccggggcttaactccgggcgtgcaggcgatacgggcataacttgagtactgtaggggtaactggaattcctggtgtagcggtgaaatgcgcagatatcaggaggaacaccgatggcgaaggcaggttactgggcagttactgacgctgaggagcgaaagcatgggtagcgaacaggattagataccctggtagtccatgccgtaaacggtgggcgctaggtgtgagggtcttttcacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgggctagagatagtctttccctttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggcccaaacttgttagggagccgtcgaaggtgggatcggcgattgggacgaagtcgtaacaaggtacccgtaccggaaggtgcgggtggatcacctcctttct

SEQ ID NO: 730 - DNA, 1502 bp, Corynebacterium tuscaniae
  modified_base (674)..(674): a, c, t, g, unknown or other
agagtttgatcctggctcaggatgaacgctggcggcgtgcttaacacatgcaagtcgaacggaaaggcccaagcttgcttgggtgctcgagtggcgaacgggtgagtaacacgtgggtgatctgccctgcacttcgggataagcctgggaaactgggtctaataccggataggaccatcgtgttgtggcggtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgttatgtgacggtacctggataagaagcaccggctaactacgtgccagcagccgcggtaatacgtagggtgcgagcgttgtccggaattactgggcgtaaagagctcgtaggtggtttgtcgcgtcgtttgtgtaataccgcagcttaactgtggggttgcaggcgatacgggcataacttgagtgctgtaggggagactggaattcctggtgtagcggtggaatgcgcanatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgctgcagagatgtagtttcccttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagctactctgtgaggggatgcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacgtgttagggagctgtcgaaggtgggatcggcgattgggacgaagtcgtaacaaggtagccgtaccggaaggtgcggctggatc

SEQ ID NO: 731 - DNA, 1508 bp, Corynebacterium ulcerans
agagtttgatcctggctcaggacgaacgctggcggcgtgcttaacacatgcaagtcgaacggaaaggccccttcgggggtactcgagtggcgaacgggtgagtaacacgtgggtgatctgcctcgtactctgggataagcctgggaaactgggtctaatactggataggaccgcactttagtgtgtgtggtggaaagttttttcggtacgagatgagcccgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgagggatgacggcctcgggttgtaaacctctttcgacagggacgaagcttttgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagggtcttccacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaagatcggcgtagagatacgttttcccttgtggtttgtatacaggtggtgcatggttgtcgtcagctcgtgtcgtgagatgttgggttaagtcccgcaacgagcgcaacccttgtcttatgttgccagcacgttatggtggggactcatgagagactgccggggttaactcggaggaaggtggggatgacgtcaaatcatcatgccccttatgtccagggcttcacacatgctacaatggtcggtacaacgcgttgcgagcctgtgagggtgagcgaatcgctgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcccaaccagtttgtctggggggagtggtcgaaggtgggatcggcgattgggacgaagtcgtaacaaggtagccgtaccggaaggtgcggctggatcacct

SEQ ID NO: 732 - DNA, 1401 bp, Corynebacterium urealyticum
  modified_base (830)..(830): a, c, t, g, unknown or other
  modified_base (882)..(882): a, c, t, g, unknown or other
acgaacgctggcggcgtgcttaacacatgcaagtcgaacggaaaggcccctgcttgcagggtactcgagtggcgaacgggtgagtaacacgtgggtgatctgcccttcacttcgggataagcctgggaaactgggtctaataccggataggaccaatctttagtgtggttggtggaaagttttttcggtggaggatgagcccgcggcctatcagcttgttggtggggtaatggcctaccaaggcgacgacgggtagccggcctgagagggtggacggccacattgggactgagacacggcccagactcctacgggaggcagcagtggggaatattgcacaatgggcggaagcctgatgcagcgacgccgcgtgagggatgacggccttcgggttgtaaacctctttcgctagggaagaagccttcgggtgacggtacctggataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcaaactggagtgctgtaggggagactggaattcctggtgtagcggtggaatgcgcagatatcaggaggaacaccgatggcgaaggcaggtctctgggcagttactgacactgaggagcgaaagcatgggtagcgaacaggattagataccctggtagtccatgccgtaaacggtgggcgctaggtgtggggatttttcacgatttccgtgccgtagctaacgcattaagcgcccngcctggggagtacggccgcaaggctaaaactcaaaggaattgacgggggccngcacaagcggcggagcatgtggattaattcgatgcaacgcgaagaaccttacctgggcttgacatacaccggatcgctgcagagatgtagtttcccttcggggctggtgtacaggtggtgcatggttgtcgtcagctcgtgtcgtgagatgttgggttaagtcccgtaacgagcgcaacccttgtcttgtgttgccagcacgttgtggtggggactcacaagagactgccggggttaactcggaggaaggtggggatgacgtcaaatcatcatgccccttatgtccagggcttcacacatgctacaatggtcgatacagtgggttgcgatgccgtgaggtggagctaatccctgaaagtcggcctcagttcggattggagtctgcaactcgactccatgaagtcggagtcgctagtaatcgcagatcagcaacgctgcggtgaatacgttcccgggccttgtacacaccgcccgtcgcgtcatgaaagttggtaacacccgaacgcagtggcctaaact

SEQ ID NO: 733 - DNA, 1480 bp, Corynebacterium ureicelerivorans
ggcgtgcttaacacatgcaagtcgaacggaaaggcccaagcttgcttgggtactcgagtggcgaacgggtgagtaacacgtgggtgatctgccctgcacttcgggataagcctgggaaactgggtctaatactggataggaccacttcttggatgttgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgctagggacgaagcgtttttgtgacggtacctggagaagaagcaccggctaactacgtgccagcagccgcggtaatacgtagggtgcagcgttgtccggaattactgggcgtaaagagctcgtaggtggtttgtcgcgtcgtttgtgtaagcccgcagcttaactgcgggactgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgtcgtagagatacggtttccctttgtggttggtgtacaggtggtgcatggttgtcgtcagctcgtgtcgtgagatgttgggttaagtcccgcaacgagcgcaacccttgtcttatgttgccagcacgttatggtggggactcgtgagagactgccggggttaactcggaggaaggtggggatgacgtcaaatcatcatgccccttatgtccagggcttcacacatgctacaatggtcggtacaacgcgcatgcgagcctgtgagggtgagcgaatcgctgtaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtcatgggagctgtcgaaggtgggatcggcgattgggacgaagtcgtaacaaggtagccgtaccggaaggtgcggctggatcacctcctttct

SEQ ID NO: 734 - DNA, 1436 bp, Corynebacterium variabile
gacgaacgctggcggcgtgcttaacacatgcaagtcgaacggaaaggccctgcttgcagggtactcgagtggcgaacgggtgagtaacacgtgggtgatctgccctgcacttcgggataagcctgggaaactgggtctaataccggataggaccatcgtttagtgtcggtggtggaaagtttttcggtgcaggatgagctcgcggcctatcagcttgttggtggggtaatggcctaccaaggcgtcgacgggtagccggcctgagagggtggacggccacattgggactgagacacggcccagactcctacgggaggcagcagtggggaatattgcacaattgggcgcaagcctgatgcagcgacgccgcgtgggggatgaaggccttcgggttgtaaactcctttcaaccatgacgaagcattatgtgacggtagtggtagaagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgggggtcttccacgacttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatgccggatcgrcgcagagatgcgttttcccttgtggtcggtatacaggtggtgcatggttgtcgtcagctcgtgtcgtgagatgttgggttaagtcccgcaacgagcgcaacccttgtcttgtgttgccagcacgttatggtggggactcgcgagagactgccggggttaactcggaggaaggtggggatgacgtcaaatcatcatgccccttatgtccagggcttcacacatgctacaatggtcggtacagtgggttgctacaccgtgaggtggtgctaatcccttaaagccggtctcagttcggattggagtctgcaactcgactccatgaagtcggagtcgctagtaatcgcagatcagcaacgctgcggtgaatacgttcccgggccttgtacacaccgcccgtcacgtcatgaaagttggtaacacccgaagccagtggcccaaactcgttagggagctgtcgaaggtgggatcggcgattgg

SEQ ID NO: 735 - DNA, 1362 bp, Corynebacterium xerosis
  modified_base (185)..(185): a, c, t, g, unknown or other
agtcgaacggtaaggccccagcttgctggggtacacgagtggcgaacgggtgagtaacacgtgggtgacctgccccgcacttcgggataagcctgggaaactgggtctaataccggataggaccgcaccgtgagggtgtggtggaaagtttttcggtgtgggatgggcccgcggcctatcagctngttggtggggtaatggcctaccaaggcggcgacgggtagccggcctgagagggtggacggccacattgggactgagacacggcccagactcctacgggaggcagcagtggggaatattgcacaatgggcggaagcctgatgcagcgacgccgcgtgggggatgacggccttcgggttgtaaactcctttcaccatcgacgaaggttttctgacggtagatggagaagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtactgtaggggagactggaattcctggtgtagcggtgaaatgcgcagatatcaggaggaacaccggtggcgaaggcgggtctctgggcagtaactgacgctgaggagcgaaagcatgggtagcgaacaggattagataccctggtagtccatgccgtaaacggtgggcgctaggtgtaggggtcttccacgacttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacgggaccgggccagagatggtccttcccttgtggctcgtatacaggtggtgcatggttgtcgtcagctcgtgtcgtgagatgttgggttaagtcccgcaacgagcgcaacccttgtcttatgttgccagcacgtaatggtggggactcgtgagaaactgccggggtcaactcggaggaaggtggggatgacgtcaaatcatcatgccccttatgtccagggcttcacacatgctacaatggtcggtacagtgggttgcgatgccgtgaggtggagctaatccctgaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggccc

SEQ ID NO: 736 - DNA, 1544 bp, Coxiella burnetii
tttaattgaagagtttgattctggctcagattgaacgctagcggcatgcttaacacatgcaagtcgaacggcagcgcggggagcttgctccctggcggcgagtggcggacgggtgagtaatgcgtaggaatctaccttgtagtgggggataacctggggaaactcgggctaataccgcataatctctttggagcaaagcgggggatcttcggacctcgtgctataagatgagcctacgtcggattagcttgttggtggggtaatggcctaccaaggcgacgatccgtagctggtctgagaggacgatcagccacactgggactgagacacggcccagactcctacgggaggcagcagtggggaatattggacaatgggggaaaccctgatccagcaatgccgcgtgtgtgaagaaggccttcgggttgtaaagcactttcggtggggaagaaattctcaagggtaatatccttgggcgttgacgttacccacagaagaagcactggctaactctgtgccagcagccgcggtaatacagagagtgcaagcgttaatcggaatcactgggcgtaaagcgcgcgtaggtggatatttaagtcggatgtgaaagccctgggcttaacctgggaattgcatccgatactgggtatcttgagtatggtagagggaagtggaatttccggtgtagcggtgaaatgcgtagatatcggaaagaacaccagtggcgaaggcgacttcctggaccaatactgacactgaggcgcgaaagcgtggggagcaaacaggattagagaccctggtagtccacgccgtcaacgatgagaactagctgttgggaagttcacttcttagtagcgaagctaacgcgttaagttctccgcctggggagtacggccgcaaggttaaaactcaaagaaattgacgggggcccgcacaagcggtggagcatgtggtttaattcgatgcaacgcgaaaaaccttacctacccttgacatcctcggaacttgtcagagatgatttggtgccttcgggaaccgagtgacaggtgctgcatggctgtcgtcagctcgtgtcgtgagatgttgggttaagtcccgtaacgagcgcaaccctcgtccttagttgccagcgagtcaagtcgggaactctaaggagactgccggtgataaaccggaggaaggtggggatgatgtcaagtcatcatggcccttacgggtagggctacacacgtgctacaatgggcagtacaaagggttgccaagccgcgaggtggagctaatcccagaaaactgctcgtagtccggattggagtctgcaactcgactccatgaagttggaatcgctagtaatcgcgaatcagcatgtcgcggtgaatacgttctcgggccttgtacacaccgcccgtcacaccatgggagtgaattgtaccagaagcgggtaggctaaccttcgggaggccgctcaccacggtatgatccatgactggggtgaagtcgtaacaaggtagccgtaggggaacctgcggctggatcacctccttact

SEQ ID NO: 737 - DNA, 1507 bp, Cronobacter malonaticus
agagtttgatcatggctcagattgaacgctggcggcaggcctaacacatgcaagtcgaacggtaacagagagcagcttgctgctctgctgacgagtggcggacgggtgagtaatgtctgggaaactgcctgatggagggggataactactggaaacggtagctaataccgcataacgtcttcggaccaaagtgggggaccttcgggcctcatgccatcagatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaagggattgtggttaataaccgcagtcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccagagaatcctgcagagatgcgggagtgccttcgggaactctgagacaggtgctgcatggctgtcgtcagctcgtgttgtgaaatgttgggttaagtcccgcaacgagcgcaacccttatcctttgttgccagcacgtaatggtgggaacccaaaggagactgccggtgataaaccggaggaaggtggggatgacgtcaagtcatcatggcccttacgaccagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtagccgta

SEQ ID NO: 738 - DNA, 1542 bp, Cronobacter sakazakii
aattgaagagtttgatcatggctcagattgaacgctggcggcaggcctaacacatgcaagtcgaacggtaacagggagtagcttgctgctctgctgacgagtggcggacgggtgagtaatgtctgggaaactgcctgatggagggggataactactggaaacggtagctaataccgcataacgtctacggaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgttgtggttaataaccacagcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccagagaatcctgcagagatgcgggagtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 739 - DNA, 312 bp, Cronobacter turicensis
  modified_base (293)..(294): a, c, t, g, unknown or other
ctcaaaggagactgccggtgataaaccggaggaaggtggggatgacgtcaagtcatcatggcccttacgaccagggctacacacgtgctacaatggcagatacaaagagaagcgacctcgcgagagcaagcggaactcataaagtgtgtcgtagtccggattggagtctgcaactcgactccatgaagtcggaatcgctagtaatcgtagatcagaatgccacggtgaatacgttcccgggccttgtacacaccgcccgtcacaccatgggagtgggttgcaaaagaagtagnnagcttaaccttcgggagg

SEQ ID NO: 740 - DNA, 1448 bp, Cryptobacterium curtum
gagtttgatcctggctcaggatgaacgctggcggcgcgcctaacacatgcaagtcgaacgattaaaccgcccttgggcggatatacagtggcgaacgggtgagtaacgcgtgaccaaccttccccccgcatcgggacaacccggggaaacccgggctaataccggatatgccgggtatggcgcatgtcatacccaggaaagcttttgcggcgggggatggggtcgcgtcccatcaggtagacggcggggtagtagcccaccgtgccaacgacgggtagccgggttgagagaccgaccggccacattgggactgagatacggcccagactcctacgggaggcagcagtggggaatcttgcgcaatgggggaaaccctgacgcagcgacgccgcgtgcgggatggaggccttcgggccgtgaaccgctttcagcagggaagacattaaggacggtacctgcagaagaagccccggctaactacgtgccagcagccgcggtaatacgtagggggcgagcgttatccggattcattgggcgtaaagcgcgcgcaggcggcgcaccaggcgggatctcgaaaccgggggctcaacctccgggcggatcccgaaccggtgtgctcgagtgcggtagaggaagtcggaattcccggtgtagcggtgaaatgcgcagatatcgggaagaacaccgatggcgaaggcagacttctgggccgacactgacgctcaggcgcgaaagctgggggagcgaacaggattagataccctggtagtcccagccgtaaacgatgggcactaggtgtggggggcatttgccttccgtgccgcagctaacgcattaagtgccccgcctggggagtacggccgcaaggctaaaactcaaaggaattgacgggggcccgcacaagcagcggagcatgtggcttaattcgaagcaacgcgaagaaccttaccagggcttgacatgtaggtgaagcgacagagatgtcgcagccgaaaggagcctacacaggtggtgcatggctgtcgtcagctcgtgtcgtgagatgttgggttaagtcccgcaacgagcgcaacccctgccgcatgttgccagcatttagttggggactcatgcgggaccgccggcggcaagccggaggaaggcggggacgacgtcaagtcatcatgccccttatgccctgggctgcacacgtgctacaatggccggcacaacgggatgcaaaggcgcgagcccaagcggatcccccaaagccggtcccagttcggatcggaggctgcaacccgcctccgtgaagccggagttgctagtaatcgcggatcagcatgccgcggtgaatacgttcccgggccttgtacacaccgcccgtcacaccacccgagtcgtctgcacccgaagtcgccggccgaacccttttgggacggaggcgccgaaggcgcgggggataaggg

SEQ ID NO: 741 - DNA, 1400 bp, Cupriavidus metallidurans
catgcaagtcgaacggcagcgcggacttcggtctggcggcgagtggcgaacgggtgagtaatacatcggaacgtaccctgttgtgggggataactagtcgaaagattagctaataccgcatacgacctgagggtgaaagtgggggaccgcaaggcctcacgcagcaggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatcgcgctggttaatacctggcgtggatgacggtaccggaagaataagcaccggctaactacgtgccagcagccgcggtaatacgtagggtgcgagcgttaatcggaattactgggcgtaaagcgtgcgcaggcggttttgtaagacaggcgtgaaatccccgggcttaacctgggaattgcgcttgtgactgcaaggctagagtgcgtcagaggggggtagaattccacgtgtagcagtgaaatgcgtagagatgtggaggaataccgatggcgaaggcagccccctgggacgtgactgacgctcatgcacgaaagcgtggggagcaaacaggattagataccctggtagtccacgccctaaacgatgtcaactagttgttggggattcattttctcagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgcccgaaagggaaagtggacacaggtgctgcatggctgtcgtcagctcgtgtcgtgagatgttgggttaagtcccgcaacgagcgcaacccttgtctctagttgctacgcaagagcactctagagagactgccggtgacaaaccggaggaaggtggggatgacgtcaagtcctcatggcccttatgggtagggcttcacacgtcatacaatggtgcgtacagagggttgccaacccgcgagggggagctaatcccagaaaacgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggttttgccagaagtagttagcctaaccgcaaggagggcgat

SEQ ID NO: 742 - DNA, 1507 bp, Cytophaga xylanolytica
gtttgatcctggctcaggatgaacgctagcgacaggcctaacacatgcaagtcgaggggcagcacgtcttcggatggtggcgaccggcgcacgggtgagtaacgcgtatgtaacctgcctacaacagggggatagctcgctgaaaagcgaattaagaccgcataagaccacgctttcgcatgttagcgtggtaaaatatttataggttgtagatgggcatgcgtgacattagctagttggtaaggtaacggcttaccaaggcaacgatgtctaggggttctgagaggaaggtcccccacactggtactgagacacggaccagactcctacgggaggcagcagtgaggaatattggtcaatgggcgagagcctgaaccagccatgtcgcgtgcaggatgacggccctacgggttgtaaactgcttttgtacgggaagaaaaaacgccacgtgtggtgtcttgccggtaccgtacgaataaggatcggctaactccgtgccagcagccgcggtaatacggaggatccgagcgttatccggatttattgggtttaaagggtgcgtaggcgggagattaagtcagtggtgaaagtttgcggctcaaccgtaaaattgccattgatactggttttcttgagtacagttgaggtaggcggaatgtggtgtgtagcggtgaaatgcttagatataccacagaacaccgattgcgaaggcagcttactaaagtgtaactgacgctgatgcacgaaagcgtggggatcaaacaggattagataccctggtagtccacgcagtaaacgatgatcactcgttgtttgcgatacattgcaagtgaccaagagaaatcgataagtgatccacctggggagtacggccgcaaggctgaaactcaaaggaattgacgggggcccgcacaagcggaggaacatgtggtttaattcgatgatacgcgaggaaccttacctgggtttaaatggggagtgacagctgccgaaaggtggtcttcttcggacactcttcaaggtgctgcatggttgtcgtcagctcgtgccgtgaggtgtcgggttaagtcccataacgagcgcaacccacgtcgttagttgccatcaggtsatgctgggcactctaacgagactgccggtgtaaaccgcgaggaaggtgtggatgacgtcaaatcagcacggcccttacatccagggctacacacgtgttacaatggccggtacagagggctgctaccatgcgaatggatgctaatcctaaaaaccggtcccagttcggattggagtctgcaacccgactccatgaagctggattcgctagtaatcgcgcatcagccatggcgcggtgaatacgttcccgggccttgtacacaccgcccgtcaagccatggaagctgagggtacctaaagtctgtcaccgtaaggagcggcctagggtaaaattggtaactggggctaagtcgtaacaaggtagccgtaccggaaggtgcggctggatcacctcctt

SEQ ID NO: 743 - DNA, 1325 bp, Deferribacteres sp.
  oral clone JV001
ggagtttgatcctggctcaggatgaacgctggcggcgtgcgtaacacatgcaagttgaacgagtagcggacgggtgagtacaacatgagaagctgtccttcagcggggggcaacgtctggaagcggacgctaataccccatagtaaaggcgcgacgggaggtactcgtgtcctatcagctagttggtgaggtaacggctcaccaaggcgacgacgggtagccggcctgagagggtgaccggccacactggaactgagatacggtccagactcctacgggaggcagcagtggggaatattgggcaatgggaggaatcctgacccagcgacgccgcgtgaacgaagacggccttcgggttgtaaagttcttttatgtgggaagatgacggtaccacatgaataagccccggctaactacgtgccagcagccgcggtaatacgtagggggcgagcgttgtccggaattactgggcgtaaagggcacgcaggctgtgcttcaagtcagctgtaaaaggatgcggcttaaccgtgttatgcagttgagactgaggtgctggagtaccggagaggcaagtggaattcccagtgtagcggtgaaatgcgtagatattgggaagaacatcggtggcgaaggcgacttgctggacggactgacgctgaggtgcgaaagccagggtagcgaacgggattagataccccggtagtcctggctgtaaacgatgaatgctaggtgtgcgagttggtgtgccgcagttaacgcgataagcattccgcctggggagtacggtcgcaagattgaaactcaaaggaattgacgggggcccgcacaagcggtggagcacgtggtttaattcgatgcaaaccgaagaaccttacctgggtttgacatgcacaggtgctgcatggctgtcgtcagctcgtgtcgtgagatgttgggttaagtcccgcaacgagcgcaacccctgcgattagttgccagcggccgggcactctaatgggactgccatcgacaagatggaggaaggtggggatgacgtcaagtcatcatggcccttatgtccagggcgacacacgtgctacaatggccggcagagggaagcgaggctgtgaggttgagcggatcccctccggtctcagttcggatgaagtctgcaattcgacttcagaagctggaatcgctagtaatcgcagatcagccaagctgcggtgaatacgttcccgggccttgtacacaccgcccgtcacaccacccgagccgggtgtacccgaagccggtgcctaaggagccgtcgaaggtgtgtctggtgaggggggtgaagtcgtaac

SEQ ID NO: 744 - DNA, 1325 bp, Deferribacteres sp.
  oral clone JV006
ggagtttgatcatggctcaggatgaacgctggcggcgtgcgtaacacatgcaagttgaacgagtagcggacgggtgagtaaagcatgagaatctgtcctgtcgagggggataacgttcggaaacggaccctaataccccatagtaaaggcgcggcaggaggagctcgtgtcctatcagctagttggtgaggtaacggctcaccaaggcttcgacgggtagccggcctgagagggtgaccggccacactggaactgagacacggtccagactcctacgggaggcagcagtggggaatattgggcaatgggagaaatcctgacccagcgacgccgcgtgaacgaagacggccttcgggttgtaaagttcttttatgtgggaagatgacggtaccacatgaataagccccggctaactacgtgccagcagccgcggtaatacgtagggggcgagcgttgtccggaattactgggcgtaaagggcacgcaggctgtgcttcaagtcagctgtaaaaggatgcggcttaaccgtgttatgcagttgagactgaggtgctggagtaccggagaggcaagtggaattcccagtgtagcggtgaaatgcgtagatattgggaagaacatcggtggcgaaggcgacttgctggacggactgacgctgaggtgcgaaagccagggtagcgaacgggattagataccccggtagtcctggccgtaaacgatgaatgctaggtgtgcgagttggtgtgccgcagttaacgcgataagcattccgcctggggagtacggtcgcaagattgaaactcaaaggaattgacgggggcccgcacaagcggtggagcacgtggtttaattcgatgcaaaccgaagaaccttacctgggtttgacatgcacaggtgctgcatggctgtcgtcagctcgtgtcgtgagatgttgggttaagtcccgcaacgagcgcaacccctgcgattagttgccagcgatcgggcactctaatgggactgccatcgacaagatggaggaaggtggggatgacgtcaagtcatcatggcccttatgtccagggcgacacacgtgctacaatggccggcagagggaagcgacactgcgaggtgaagcggatcccatccgctctcagttcggatgaagtctgcaattcgacttcagaagttggaatcgctagtaatcgcagatcaaccaagctgcggtgaatccgtccccgggccttgtacacaccgcccgtcacaccacccgagccgggtgtacccgaggccggtgcctaaggagccgtcgaaggtgtgtctggtgaggggggtgaagtcgtaac

SEQ ID NO: 745 - DNA, 1325 bp, Deferribacteres sp.
  oral clone JV023
ggagtttgatcctggctcaggatgaacgctggcggcgtgcgtaacacatgcaagttgaacgagtagcggacgggtgagtaaagcatgagaatctgtcctgccgagggggataacgttcggaaacggaccctaataccccatagtaaaggcgcggcaggaggagctcgtgtcctatcagctggttggtgaggtaagggctcaccaaggcttcgacgggtagccggcctgagagggtgaccggccacactggaactgagagacggtccagactcctacgggaggcagcagtggggaatattgggcaatgggaggaatcctgacccagcgacgccgcgtgaacgaagacggccttcgggttgtaaagttcttttatgtgggaagatgacggtaccacatgaataagccccggctaactacgtgccagcagccgcggtaatacgtagggggcgagcgttgtccggaattactgggcgtaaagggcacgcaggctgtgcttcaagtcagctgtaaaaggatgcggcttaaccgtgttatgcagttgagactgaggtgctggagtaccggagaggcaagtggaattcccagtgtagcggtgaaatgcgtagatattgggaagaacatcggtggcgaaggcgacttgctggacggactgacgctgaggtgcgaaagccagggtagcgaacgggattagataccccggtagtcctggcggtaaacgatgaatgctaggtgtgcgagttggtgtgccgcagttaacgcgataagcattccgcctggggagtacggtcgcaagattgaaactcaaaggaattgacgggggcccgcacaagcggtggagcacgtggtttaattcgatgcaaaccgaagaaccttacctgggtttgacatgcacaggtgctgcatggctgtcgtcagctcgtgtcgtgagatgttgggttaagtcccgcaacgagcgcaacccctgcgattagttgctaacggccgagcactctaatgggactgccatcgacaagatggaggaaggtggggatgacgtcaagtcatcatggcccttatgtccagggcgacacacgtgctacaatggccggcagagggaagcgaggctgtgaggttgagcggatcccctccggtcacagttcggatgaagtctgcaattcgacttcagaagctggaatcgctagtaatcgcagatcagccaagctgcggtgaatacgttcccgggccttgtacacaccgcccgtcacaccacccgagccgggtgtacccgaagccggtgcctaaggagccgtcgaaggtgtgtctggtgaggggggtgaagtcgtaac

SEQ ID NO: 746 - DNA, 1502 bp, Deinococcus radiodurans
tttatggagagtttgatcctggctcagggtgaacgctggcggcgtgcttaagacatgcaagtcgaacgcggtcttcggaccgagtggcgcacgggtgagtaacacgtaactgacctacccagaagtcacgaataactggccgaaaggtccgctaatacgtgatgtggtgatgcaccgtggtgcatcactaaagatttatcgcttctggatggggttgcgttccatcagctggttggtggggtaaaggcctaccaaggcgacgacggatagccggcctgagagggtggccggccacaggggcactgagacacgggtcccactcctacgggaggcagcagttaggaatcttccacaatgggcgcaagcctgatggagcgacgccgcgtgagggatgaaggttttcggatcgtaaacctctgaatctgggacgaaagagccttagggcagatgacggtaccagagtaatagcaccggctaactccgtgccagcagccgcggtaatacggagggtgcaagcgttacccggaatcactgggcgtaaagggcgtgtaggcggaaatttaagtctggttttaaagaccggggctcaacctcggggatggactggatactggatttcttgacctctggagaggtaactggaattcctggtgtagcggtggaatgcgtagataccaggaggaacaccaatggcgaaggcaagttactggacagaaggtgacgctgaggcgcgaaagtgtggggagcaaaccggattagatacccgggtagtccacaccctaaacgatgtacgttggctaagcgcaggatgctgtgcttggcgaagctaacgcgataaacgtaccgcctgggaagtacggccgcaaggttgaaactcaaaggaattgacgggggcccgcacaagcggtggagcatgtggtttaattcgaagcaacgcgaagaaccttaccaggtcttgacatgctaggaactttgcagagatgcagaggtgcccttcggggaacctagacacaggtgctgcatggctgtcgtcagctcgtgtcgtgagatgttgggttaagtcccgcaacgagcgcaacccttgcctttagttgtcagcattcagttggacactctagagggactgcctatgaaagtaggaggaaggcggggatgacgtctagtcagcatggtccttacgtcctgggcgacacacgtgctacaatgggtaggacaacgcgcagcaaacccgcgagggtaagcgaatcgctaaaacctatccccagttcagatcggagtctgcaactcgactccgtgaagttggaatcgctagtaatcgcgggtcagcataccgcggtgaatacgttcccgggccttgtacacaccgcccgtcacaccatgggagtagattgcagttgaaaccgccgggagcttaacggcaggcgtctagactgtggtttatgactggggtgaagtcgtaacaaggtaactgtaccggaaggtgcggttggatcacctccttt

SEQ ID NO: 747 - DNA, 1333 bp, Deinococcus sp.
  R-43890
ggtgaacgctggcggcgtgcttaagacatgcaagtcgaacgagatcttcggatctagtggcgcacgggtgagtatcgcgtgactgacctgccccaaagttccgaataactggctgaaaggtcagctaatacggaatgtgcagcatcctcgtgtggatgttgtaaaggctatgaccgctttgggatggggttgcgttccatcagctagttggtggggtaaaggcccaccaaggcgacgacggataaccggcctgagagggtggccggtcacaggggcactgagacacgggtcccactcctacgggaggcagcagttaggaatcttccccaatggacgaaagtctgagggagcgacgccgcgtgagggatgaaggttttcggatcgtaaacctctgaatctgggacgaaagaccgggacaaccggagatgacggtaccagagtaatagcaccggctaactccgtgccagcagccgcggtaatacggagggtgcaagcgttacccggaatcactgggcgtaaagggcgtgtaggcggcatcacaagtctggttttaaagcctgcggctcaaccgcagagatggactggagactgtgaagctagacctctggagagagaactggaattcctggtgtagcggtggaatgcgtagataccaggaggaacaccgatggcgaaggcaggttcttggacagaaggtgacgctgaggcgcgaaagtgtggggagcaaaccggattagatacccgggtagtccacaccctaaacgatgtacgttggcctacagcaggatgctgttgtgggcgaagctaacgcgataaacgtaccgcctgggaagtacggccgcaaggttgaaactcaaaggaattgacgggggcccgcacaagcggtggagcatgtggtttaattcgaagcaacgcgaagaaccttaccaggtcttgacatccatagaagctcccggagacgggagcgtgcccttcggggagctatgagacaggtgctgcatggctgtcgtcagctcgtgtcgtgagatgttgggttaagtcccgcaacgagcgcaacccctaccttcagttgccagcattcagttgggcactctgacgggactgcctatgaaagtaggaggaaggcggggatgacgtctagtcagcatggtccttacgacctgggctacacacgtgctacaatggatggtacaacgcgcagccaactcgcgagagtgagcgaatcgccaaaagccatccccagttcagatcggagtctgcaactcgactccgtgaagttggaatcgctagtaatcrcgggtcagcataccgsgrtgaatacgttcccgggcct

SEQ ID NO: 748 - DNA, 1526 bp, Delftia acidovorans
agagtttgatcctggctcagattgaacgctggcggcatgccttacacatgcaagtcgaacggtaacaggtcttcggacgctgacgagtggcgaacgggtgagtaatacatcggaacgtgcccagtcgtgggggataactactcgaaagagtagctaataccgcatacgatctgaggatgaaagcgggggaccttcgggcctcgcgcgattggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgaaagcctgatccagcaatgccgcgtgcaggatgaaggccttcgggttgtaaactgcttttgtacggaacgaaaaagcttctcctaatacgagaggcccatgacggtaccgtaagaataagcaccggctaactacgtgccagcagccgcggtaatacgtagggtgcgagcgttaatcggaattactgggcgtaaagcgtgcgcaggcggttatgtaagacagatgtgaaatccccgggctcaacctgggaactgcatttgtgactgcatggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggaattagttttctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatggcaggaagtttccagagatggattcgtgctcgaaagagaacctgcacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacagagggttgccaacccgcgagggggagctaatcccataaaaccagtcgtagtccggatcgcagtctgcaactcgactgcgtgaagtcggaatcgctagtaatcgcggatcagcatgccgcggtgaatacgttcccgggtcttgtacacaccgcccgtcacaccatgggagcgggtctcgccagaagtaggtagcctaaccgcaaggagggcgcttaccacggcggggttcgtgactggggtgaagtcgtaacaaggtagccgtatcggaaggtgcggctggatcacctccttt

SEQ ID NO: 749 - DNA, 1394 bp, Dermabacter hominis
catgcaagtcgaacgatgaagctgtgcttgcacagtggattagtggcgaacgggtgagtaacacgtgagtaacctgcccttcactttgggataactccgagaaatcggggctaataccggatatgactactggccgcatggttggtggtggaaagtttttcggtgagggatgggctcgcggcctatcagtttgttggtgaggtagtggctcaccaaggcgatgacgggtagccggcctgagagggcgaccggccacactgggactgagacacggcccagactcctacgggaggcagcagtggggaatattgcacaatgggcgaaagcctgatgcagcgacgccgcgtgggggatgacggccttcgggttgtaaacctctttcagcaaggaagaagcgaaagtgacggtacttgcagaagaagcgccggctaactacgtgccagcagccgcggtaatacgtagggcgcaagcgttgtccggaattattgggcgtaaagagcttgtaggtggcttgtcgcgtctgccgtgaaaacccgaggcttaaccttgggcgtgcggtgggtacgggcaggctagagtgcggtaggggagactggaattcctggtgtagcggtgaaatgcgcagatatcaggaggaacaccgatggcgaaggcaggtctctgggccgttactgacactgagaagcgaaagcatggggagcgaacaggattagataccctggtagtccatgccgtaaacgttgggcactaggtgtggggagcattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcactggatcgctgcagagatgtggttttctttggactggtgcacaggtggtgcatggttgtcgtcagctcgtgtcgtgagatgttgggttaagtcccgcaacgagcgcaaccctcgttccatgttgccagcacttcgggtggggactcatgggagactgccggggtcaactcggaggaaggtggggacgacgtcaaatcatcatgccccttatgtcttgggcttcacgcgtgctacaatggtcggtacaatgggttgcgatactgtgaggtggagctaatcccaaaaagccggtctcagttcggattggggtctgcaactcgaccctatgaagtcggagtcgctagtaatcgcagatcagcaatgctgcggtgaatacgttcccgggccttgtacacaccgcccgtcaagtcacgaaagtcggtaacacccgaagccgatggcccaagcttttgcggggagtcgtcgaaggt

SEQ ID NO: 750 - DNA, 1520 bp, Dermacoccus sp.
  Ellin185
  modified_base (434)..(435): a, c, t, g, unknown or other
tttctacggagagtttgatcctggctcaggacgaacgctggcggcgtgcttaacacatgcaagtcgaacgatgaagcaccagcttgctggtgtggattagtggcgaacgggtgagtaacacgtgagtaacctgcccctcactctgggataagcctgggaaactgggtctaatactggatacgaccgatctccgcatggagtgttggtggaaagtttttgtggtgggggatggactcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaannttcaccagggacgaagctaacgtgacggtacctggagaagaagcaccggctaactacgtgccagcagccgcggtaatacgtagggtgcggcgttgtccggaattattgggcgtaaagagcttgtaggcggtctgtcgcgtctgctgtgaaagaccggggcttaactccggttctgcagtgggtacgggcagactagagtgtggtaggggagactggaattcctggtgtagcggtgaaatgcgcagatatcaggaggaacaccgatggcgaaggcaggtctctgggccattactgacgctgagaagcgaaagcatggggagcgaacaggattagataccctggtagtccatgccgtaaacgttgggcgctaggtgtgggactcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaatcatgcagagatgtgtgcgtcttcggactggtgtacaggtggtgcatggttgtcgtcagctcgtgtcgtgagatgttgggttaagtcccgcaacgagcgcaaccctcgttccatgttgccagcacttcgggtggggactcatgggagactgccggggtcaactcggaggaaggtggggatgacgtcaaatcatcatgccccttatgtcttgggcttcacgcatgctacaatggccggtacagagggttgcgaaaccgtgaggtggagctaatcccaaaaaaccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcctaacccttgtggggggagccgtcgaaggtgggactggcgattgggactaagtcgtaacaaggtagccgtaccggaaggtgcggctggatcacctccttt

SEQ ID NO: 751 - DNA, 1522 bp, Desmospora activa
gctggcggcgtgcctaatacatgcaagtcgagcggaccgatggagagcttgctctcttgaagtcagcggcgaacgggtgagtaacacgtgggcaacctgcccgcaagactgggataactccgggaaaccggggctaataccggatacgatcttccctcgcatgagagaagatggaaaggcggcatcacgctgtcacttgcggatgggcccgcggcgcattagctagttggtgaggtagtggctcaccaaggcgacgatgcgtagccgacctgagagggtgaccggccacactgggactgagacacggcccagactcctacgggaggcagcagtagggaattttcgtcaatgggcgcaagcctgaacgagcaacgccgcgtgagtgaggacggctttcgggttgtaaagctctgttcttcgggaagaacgacagaagggtgaataatccttttgtgtgacggtaccggagaagaaagccccggctaactacgtgccagcagccgcggtaatacgtagggggcaagcgttgtccggaattattgggcgtaaagcgcgcgcaggcggcctgttaagtcggatgtgaaagaccacggctcaaccgtgggggtgcatccgaaactggcgggcttgagtgcaggagaggggagtggaattcccggtgtagcggtggaatgcgtagagatcgggaggaacaccagtggcgaaggcggctctctggcctgtaactgacgctgaggcgcgaaagcgtggggagcaaacaggattagataccctggtagtccacgccgtaaacgatgagtgctaggtgttgggggtttcacgccctctgtgccgaaggtaacccaataagcactccgcctggggagtacggccgcaaggctgaaactcaaaggaattgacgggggcccgcacaagcggtggagcatgtggtttaattcgaagcaacgcgaagaaccttaccagggcttgacatcccgctgaccccttcagagatgaaggttcccttcggggcagcggagacaggtggtgcatggttgtcgtcagctcgtgtcgtgagatgttgggttcagtcccgcaacgagcgcaacccttatcgttagttgccagcacctcgggtgggcactctagcgagacagccggtgaaagccggaggaaggtggggatgaggtcaaatcatcatgccccttatgtcctgggcaacacacgtgctacaatggctggtacaacgggtcgcgaagccgcgaggtggagccaatcccaaaaaaccagtctcagttcggatcgcaggctgcaactcgcctgcgtgaagctggaatcgctagtaatcgcggatcagcatgccgcggtgaatacgttcccgggccttgtacacaccgcccgtcacaccacgagagtttgcaacacccgaagtcggtgagggaacccttttgggacccagccgccgaaggtggggcagatgattggggtgaagtcgtaacaaggtatccctaccggaaggtggggctggatcacctcctttcta

SEQ ID NO: 752 - DNA, 1455 bp, Desmospora sp.
  8437
agcggcggacgggtgagtaacacgtgggcaacctgcccgcaagaccgggataactccgggaaaccggggctaataccggatgatgcctcttcctgcatgggaggatgctgaaaggcggcctttggctgtcacttgcggatgggcccgcggcgcattagctggttggtgaggtaacggctcaccaaggcgacgatgcgtagccgacctgagagggtgatcggccacactgggactgagacacggcccagactcctacgggaggcagcagtagggaattttccgcaatgggcgcaagcctgacggagcaacgccgcgtgagtgaggacggctttcgggttgtaaaactctgttcttcgggaagaacggtcgaagggtgaacaatcctttggcgtgacggtaccggaggagaaagccccggctaactacgtgccagcagccgcggtaatacgtagggggcaagcgttgtccggaattattgggcgtaaagcgcgcgcaggcggcctgttaagtctggtgtgaaagaccacggctcaaccgtggggtggcatcagaaactggcgggcttgagtgcaggagaggagagtggaattcccggtgtagcggtggaatgcgtagagatcgggaggaacaccagtggcgaaggcgactctctggcctgtaactgacgctgaggcgcgaaagcgtggggagcgaacaggattagataccctggtagtccacgccgtaaacgatgagtgctaggtgttgggggtttccgccctctgtgccgaaggtaacccaataagcactccgcctggggagtacggccgcaaggctgaaactcaaaggaattgacgggggcccgcacaagcggtggagcatgtggtttaattcgaagcaacgcgaagaaccttaccagggcttgacatcccgctgaccggtgtagagatacaccttcccttcggggcagcggtgacaggtggtgcatggttgtcgtcagctcgtgtcgtgagatgttgggttcagtcccgcaacgagcgcaacccttgtcgtcagttgccagcacatgatggtgggcactctggcgagacagccggtgaaagccggaggaaggtggggatgacgtcaaatcatcatgccccttatgtcctgggctacacacgtgctacaatggccggtacaacgggcagcgaacccgtgagggggagccaatcccaaaaaaccggtctcagttcggatcgcaggctgcaactcgcctgcgtgaagctggaatcgctagtaatcgcggatcagcatgccgcggtgaatccgttcccgggccttgtacacaccgcccgtcacaccacgagagtctgcaacacccgaagtcggtgaggtaaccttcgggaaccagccgccgaaggtggggcagatgattggggtgaagtcgtaacaaggtatccctaccggaaggtggggatggatcacctcctttct

SEQ ID NO: 753 - DNA, 1456 bp, Desulfitobacterium frappieri
  modified_base (968)..(968): a, c, t, g, unknown or other
cactgagtgctaaacgttagttagtggcggacgggtgagtaacgcgtggataacctacctagtagaccgggacaacccttggaaacgagggctaataccggatgagcttaattagtggcatcactgattaaggaaagatggcctctgaagatgctatcgttagtagatggatccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtacgacgaaggccttcgggttgtaaagtactgtcttcagggacgaacggtaagtatgtaaataatgtacttacatgacggtacctgaggaggaagccccggctaactacgtgccagcagccgcggtaatacgtagggggcaagcgttgtccggaatcattgggcgtaaagggcgcgtaggcggatacttaagtctggtgtgaaaacctagggctcaaccctgggactgcatcggaaactgggtatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacactaagcactccgcctggggagtacggccgcaaggttgaaactcaaaggaattgacgggggcccgcacaagcggtggagcatgtggtttaattcgacgcaacgcgaagaaccttaccaaggcttgacatccatagaatcctgtggaaacatgggagtgnccttcggggagctatgagacaggtggtgcatggttgtcgtcagctcgtgtcgtgagatgttgggttaagtcccgcaacgagcgcaacccctatgtttagttgctaacgcgtaatggtgagcactctagacagactgccggtgacaaaccggaggaaggtggggatgacgtcaaatcatcatgccccttatgtcttgggctacacacgtgctacaatggccagtacagacggaagcgaagccgtgaggtgaagccaatccgagaaagctggtctcagttcggattgttctctgcaactcgagaacatgaagtcggaatcgctagtaatcgcaggtcagcatactgcggtgaatacgttcccgggccttgtacacaccgcccgtcacaccacgaaagtctgcaacacccgaagccggtgaggtaacccgaaagggagctagccgtcgaaggtggggccgatgattggggtgaagtcgtaacaaggtatcc

SEQ ID NO: 754 - DNA, 1554 bp, Desulfitobacterium hafniense
agagtttgatcctggctcaggacgaacgctggcggcgtgcctaacacatgcaagtcgaacggagagctcaataagcttgcttagagagttcttagtggcggacgggtgagtaacgcgtggataacctacctagtagaccgggacaacccttggaaacgagggctaataccggataagcttaattagtggcatcactgattaaggaaagatggcctctgaagatgctatcgttagtagatggatccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtacgacgaaggccttcgggttgtaaagtactgtcttcagggacgaacggtaagtatgtaaagaatgtacttacatgacggtacctgaggaggaagccccggctaactacgtgccagcagccgcggtaatacgtagggggcaagcgttgtccggaatcattgggcgtaaagggcgcgtaggcggatacttaagtctggtgtgaaaacctagggctcaaccctgggactgcatcggaaactgggtatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacactaagcactccgcctggggagtacggccgcaaggttgaaactcaaaggaattgacgggggcccgcacaagcggtggagcatgtggtttaattcgacgcaacgcgaagaaccttaccaaggcttgacatccatagaatcctgtggaaacatgggagtgcccttcggggagctatgagacaggtggtgcatggttgtcgtcagctcgtgtcgtgagatgttgggttaagtcccgcaacgagcgcaacccctatgtttagttgctaacgcgtaatggtgagcactctagacagactgccggtgacaaaccggaggaaggtggggatgacgtcaaatcatcatgccccttatgtcttgggctacacacgtgctacaatggccagtacagacggaagcgaagccgtgaggtgaagccaatccgagaaagctggtctcagttcggattgttctctgcaactcgagaacatgaagtcggaatcgctagtaatcgcaggtcagcatactgcggtgaatacgttcccgggccttgtacacaccgcccgtcacaccacgaaagtctgcaacacccgaagccggtgaggtaacccgaaagggagctagccgtcgaaggtggggccgatgattggggtgaagtcgtaacaaggtagccgtatcggaaggtgcggctggatcacct

SEQ ID NO: 755 - DNA, 1557 bp, Desulfobulbus sp.
  oral clone CH031
gagagtttgatyctggctcagaacgaacgctggcggcgtgcttaacacatgcaagtcgaacgcgaacgggacttcggttcctagtagagtggcgcacgggtgagtaacgcgtagataacctgtcttcatatccggaataacacgccgaaaggggtactaataccggatgttcttgcatttcacaggtaaggcaaggaaaggtggcctctgattcaagctactgtatgaagaggggtctgcgtaccattagctagtaggtggggtaatggcctacctaggcgacgatggttagcgggtctgagaggatgatccgccacactggcactggaatacgggccagactcctacgggaggcagcagtgaggaatattgcgcaatgggggcaaccctgacgcagcgacgccgcgtgagtgaggaaggtcttcggatcgtaaagctctgtcaagagggaagaagtgcaaggcagcgaataactgttttgtttgacggtacctctaaaggaagcaccggctaactccgtgccagcagccgcggtaatacggagggtgcgagcgttgttcggaatcactgggcgtagagggcgcgcaggcgggctgtcaagtcagatgtgaaatcccacggcttaactgtggacgtgcatttgaaactggcagtcttgagtaccagaggggaatgtggaattcccggtgtagaggtgaaattcgtagatatcgggaggaataccggtggcgaaggcgacattctggctggatactgacgctgaggcgcgaaagcgtggggagcaaacaggattagataccctggtagtccacgccgtaaacgatgtgaactagatgcagggggtgttgatcccctctgtgtcgcggctaacgcattaagttcaccgcctggggagtacggtcgcaagattaaaactcaaaggaattgacgggggcccgcacaagcggtggggtatgtggtttaattcgatgcaacgcgaagaaccttacctggtcttgacatcccggagacgcccatgaaagtgggtggtgccttctttgaaggaatccggagacaggtgctgcatggctgtcgtcagctcgtgtcgtgagatgttgggttaagtcccgcaacgagcgcaacccttgccttcagttgccagcggttcggccgggcactctgaagggactgccggtgtcaaaccggaggaaggtggggatgacgtcaagtcctcatggcccttatgaccagggctacacacgtactacaatggccggtacaaaggggagcgacattgcgaaatggagccaatcccgcaaagccggtctcagtccggattggagtctgcaactcgactccatgaagttggaatcgctagtaatcgtggatcagcatgccacggtgaatacgttcccgggccttgtacacaccgcccgtcacaccacgggagtcggttgtaccagaagcagttgagctaaccgcaagggggcaggctgccaaggtacggctggtaactggggtgaagtcgtaacagggtagccctaggggaacctggggctggatcacctccttaagggc

SEQ ID NO: 756 - DNA, 1431 bp, Desulfotomaculum nigrificans
  modified_base (1)..(1): a, c, t, g, unknown or other
  modified_base (43)..(46): a, c, t, g, unknown or other
  modified_base (66)..(66): a, c, t, g, unknown or other
  modified_base (186)..(186): a, c, t, g, unknown or other
  modified_base (415)..(415): a, c, t, g, unknown or other
  modified_base (419)..(419): a, c, t, g, unknown or other
  modified_base (615)..(615): a, c, t, g, unknown or other
  modified_base (619)..(619): a, c, t, g, unknown or other
  modified_base (891)..(891): a, c, t, g, unknown or other
  modified_base (897)..(897): a, c, t, g, unknown or other
  modified_base (906)..(906): a, c, t, g, unknown or other
  modified_base (1420)..(1420): a, c, t, g, unknown or other
natagtttgatcctggctcaggacgaacgctggcggcgtgccnnnnacatgcaagtcgaacggggntgaatgaagcttggcgatttctaaacctagtggcggacgggtgagtaacgcgtggataacctgcctggtagaccgggataacagctggaaacggctgctaataccggatacgctcttggngccgcatggtgccgagaggaaaggggagccgctatcagatggatccgcgtcccattagctggttggtggtgtagcggaccaccaaggcgacgatgggtagccggcctgagagggcgaccggccacactgggactgagacacggcccagactcctacgggaggcagcagtggggaatcttccgcaatgggcgaaagctgacggagcaacgccgcgtgagggaagaaggcntcgngttgtaaacctctgtcctaaaggaagaaagaaatgacggtactttaggaagaatgacggtactttaggaggaagccccggctaactacgtgccagcagccgcggtaaaacgtagggggcgagcgttgtccggaattactgggcgtaaagggcgcgtaggtggtccattaagttagaggtgaaagtgcggggcttancccngtgattgcctctgatactggtggacttgagtgcaggagaggggagcggaattcccagtgtagcggtgaaatgcgtagatattgggaggaacaccagtggcgaaggcggctctctggactgcaactgacactgaggcgcgaaagcgtggggagcaaacaggattagataccctggtagtccacgccgtaaacgatgagtgctaggtgttgcgggtatcgacccctgcagtgccgcagtaaacacaataagcactccgcctggggagtacggtngcaagnctgaaactnaaaggaattgacggggccccgcacaagcggtggagtatgtggtttaattcgacgcaacgcgaagaaccttaccagggcttgacatcccgcgcaccactctagagatagagggttctgccttagggtagacgcgcagacaggtggtgcatggttgtcgtcagctcgtgtcgtgagatgttgggttaagtcccgcaacgcgcgcaacccctaacattagttgccagcgatagagacggggactctaatgtgactgccgttgacaaaacggaggaaggtggggatgacgtcaaatcatcatgccccttatgtcctgggctacacacgtactacaatggccggtactaacggatgcgaatggcgtgagccggagcaaaactgagaaagccggtctcagttcggattgtagtctgcaactcgactacatgaagtcggaatcgctagtaatcgcaggtcagcatactgcggtgaatacgttcccgggccttgtacacaccgcccgtcacaccacgaaagntgacaacaccc

SEQ ID NO: 757 - DNA, 1548 bp, Desulfovibrio desulfuricans
attagagtttgatcctggctcagattgaacgctggcggcgtgcttaacacatgcaagtcgaacgcgaaagggacttcggtcctgagtaaagtggcgcacgggtgagtaacgcgtggataatctgcccttatgatcgggataacagttggaaacggctgctaataccggatacgctcaaaatgaactttttgaggaaagatggcctctgcttgtatgctatcacgtaaggatgagtccgcgtcccattagcttgttggcggggtaacggcccaccaaggcatcgatgggtagccgatttgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcagaagggaagaaactacgttgtgctaatcagcagcgtactgacggtaccttcaaaggaagcaccggctaactccgtgccagcagccgcggtaatacggagggtgcaagcgttaatcggaattactgggcgtaaagcgcacgtaggctgtagtgtaagtcaggggtgaaatcccacggctcaaccgtggaactgcctttgatactgcacaacttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatccacggaaccctcccgaaaaggaggggtgcccttcggggagccgtgagacaggtgctgcatggctgtcgtcagctcgtgtcgtgagatgttgggttaagtcccgcaacgagcgcaacccctatggatagttgccagcaagtaatgttgggcactctattcagactgcccgggttaaccgggaggaaggtggggacgacgtcaagtcatcatggcccttacgcctagggctacacacgtactacaatggcgcgcacaaaggggagcgagaccgcgaggtggagccaatcccaaaaaacgcgtcccagtccggattgcagtctgcaactcgactgcatgaagttggaatcgctagtaattcgagatcagcatgctcgggtgaatgcgttcccgggccttgtacacaccgcccgtcacaccacgaaagtcggttttacccgaagccggtgagccaaccagcaatggaggcagccgtctacggtagggccgatgattggggtgaagtcgtaacaaggtagccgtaggggaacctgcggctggatcacctccttaat

SEQ ID NO: 758 - DNA, 1394 bp, Desulfovibrio fairfieldensis
tcgaacgcgaaagagacttcggtctcgagtagagtggcgcacgggtgagtaacgcgtggataatctgccctcatgaccgggataacagttggaaacggctgctaataccggatacgctctgaatgaacttttaggggaaagacggcctctgcttgcaagctgtcgtatgaggatgagtccgcgtcccattagctagttggcggggtaacggcccaccaaggcaacgatgggtagccgatctgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcagaagggaagaaagtgcgtggtgctaatcagccgcgcattgacggtaccttcaaaggaagcaccggctaactccgtgccagcagccgcggtaatacggagggtgcaagcgttaatcggaattactgggcgtaaagcgcacgtaggctgttgtgtaagtcaggggtgaaatcccacggctcaaccgtggaactgcccttgatactgcatgacttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatctggggaaccctcccgaaaaggaggggtgcccttcggggagccccaagacaggtgctgcatggctgtcgtcagctcgtgtcgtgagatgttgggttaagtcccgcaacgagcgcaacccctatgcatagttgccagcaagtgaagttgggcactctatgcagactgcccgggttaaccgggaggaaggtggggacgacgtcaagtcatcatggcccttacacctagggctacacacgtactacaatggcgcgcacaaaggggagcgagaccgcgaggtggagccaatcccaaaaaacgcgtcccagtccggattgcagtctgcaactcgactgcatgaagtcggaatcgctagtaattcgagatcagcatgctcgggtgaatgcgttcccgggccttgtacacaccgcccgtcacaccacgaaagtcggttttacccgaagccggtgagccaacc

SEQ ID NO: 759 - DNA, 1053 bp, Desulfovibrio piger
  modified_base (44)..(44): a, c, t, g, unknown or other
  modified_base (49)..(50): a, c, t, g, unknown or other
  modified_base (699)..(699): a, c, t, g, unknown or other
  modified_base (713)..(713): a, c, t, g, unknown or other
  modified_base (861)..(861): a, c, t, g, unknown or other
  modified_base (893)..(894): a, c, t, g, unknown or other
  modified_base (941)..(942): a, c, t, g, unknown or other
  modified_base (959)..(960): a, c, t, g, unknown or other
  modified_base (965)..(965): a, c, t, g, unknown or other
  modified_base (974)..(974): a, c, t, g, unknown or other
  modified_base (979)..(980): a, c, t, g, unknown or other
  modified_base (1009)..(1010): a, c, t, g, unknown or other
  modified_base (1018)..(1019): a, c, t, g, unknown or other
  modified_base (1023)..(1023): a, c, t, g, unknown or other
  modified_base (1030)..(1030): a, c, t, g, unknown or other
  modified_base (1042)..(1042): a, c, t, g, unknown or other
cgcgaagggacttcggtcccgagtaaagtggcgcacgggtgagnaacanntggataatctgcctctatgatggggataacagttggaaacgactgctaataccgaatacgctcatgatgaactttgtgaggaaaggtggcctctgcttgcaagctatcgcatagagatgagtccgcgtcccattagctagttggtggggtaacggcctaccaaggcaacgatgggtagccgatctgagaggatgatcggccacactggaactgaaacacggtccagactcctacgggaggcagcagtggggaatattgcgcaatgggcgaaagcctgacgcagcgacgccgcgtgagggatgaaggtcttcggatcgtaaacctctgtcagaagggaagaaactagggtgctctaatcatcatcctactgacggtaccttcaaaggaagcaccggctaactccgtgccagcagccgcggtaatacggagggtgcaagcgttaatcggaatcactgggcgtaaagcgcacgtaggctgttatgtaagtcaggggtgaaatcccacggctcaaccgtggaactgcccttgatactgcacgacttgaatccgggagagggtggcggaattccaggtgtaggagtgaaatccgtagatatctggaggaacatcagtggcgaaggcggccacctggaccggtattgacgctgangtgcgaaagcgtgnggagcaaacaggattagataccctggtagtccacgccgtaaacgatggatgctggatgtcgggatgtatgtctcggtgtcgtagttaacgcgttaagcatcccgcctggggagtacggtcgcaaggctgaaactcaaagaaattgacnggggcccgcacaagcggtggagtatgtggttnnattcgatgcaacgcgaagaaccttacctaggtttgacatctgggganncctcccgaaaaggaggnntgccnttcgggganccccnnacaggtgctgcatggctgtcgtcagctcnngtcgtganntgtnggttaantcccgcaacgancgcacccctat

SEQ ID NO: 760 - DNA, 1027 bp, Desulfovibrio sp.
  3_1_syn3
  modified_base (8)..(8): a, c, t, g, unknown or other
  modified_base (12)..(15): a, c, t, g, unknown or other
  modified_base (21)..(21): a, c, t, g, unknown or other
ggatcgtnaacnnnntcagangggaagaaagtgcgtggtgctaatcagccgcgcattgacggtaccttcaaaggaagcaccgggctaactccgtgccagcagccgcggtaatacggagggtgcaagcgttaatcggaattactgggcgtaaagcgcacgtaggctgttgtgtaagtcaggggtgaaatcccacggctcaaccgtggaactgcccttgatactgcatgacttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatctggggaaccctcccgaaaaggaggggtgcccttcggggagccccaagacaggtgctgcatggctgtcgtcagctcgtgtcgtgagatgttgggttaagtcccgcaacgagcgcaacccctatgcatagttgccagcaagtgaagttgggcactctatgcagactgcccgggttaaccgggaggaaggtggggacgacgtcaagtcatcatggcccttacacctagggctacacacgtactacaatggcgcgcacaaaggggagcgagaccgcgaggtggagccaatcccaaaaaacgcgtcccagtccggattgcagtctgcaactcgactgcatgaagtcggaatcgctagtaattcgagatcagcatgctcgggtgaatgcgttcccgggccttgtacacaccgcccgtcacaccacgaaagtcggttttacccgaagccggtgagccaacc

SEQ ID NO: 761 - DNA, 1542 bp, Desulfovibrio vulgaris
agagtttgattctggctcagattgaacgctggcggcgtgcttaacacatgcaagtcgcgcgtgaaaggacttcggtccgagtaaagcggcgcacgggtgagtaacgcgtggatgatctacccatgagttaggaataacggctggaaacggtcgctaataccaaatacgctccgatttcaacttcgggggaaaggtggcctctgcttgcaagctactgctcatggatgagtccgcgtcccattagctagttggtggggtaacggcccaccaaggcgacgatgggtagccggtctgagaggatgaccggccacactgggactggaacacggcccagactcctacgggaggcagcagtggggaatattgcgcaatgggcgaaagcctgacgcagcgacgccgcgtgagggatgaaggtcctcggatcgtaaacctctgtcaggagggaagaaccgccacggtgctaatcagccgtggtctgacggtacctccaaaggaagcaccggctaactccgtgccagcagccgcggtaatacggagggtgcgagcgttaatcggaatcactgggcgtaaagcgcacgtaggctgcttggtaagtcaggggtgaaagcccgcggctcaaccgcggaattgcctttgatactgccgagctagagtccgggagagggtagtggaattccaggtgtaggagtgaaatccgtagagatctggaggaacatcagtggcgaaggcgactacctggaccggtactgacgctgaggtgcgaaagcgtggggagcaaacaggattagataccctggtagtccacgccgtaaacgatggatgctaggtgtcggggccttgagcttcggtgccgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatccggaagaccttcccgaaaaggaagggtgcccttcggggaattccgagacaggtgctgcatggctgtcgtcagctcgtgccgtgaggtgttgggttaagtcccgcaacgagcgcaacccctattgccagttgctaccaggtaatgctgggcactctggtgagactgccccggttaacggggaggaaggtggggacgacgtcaagtcatcatggcccttacgcctagggctacacacgtactacaatggcgcatacaaagggcagcgataccgcgaggtggagccaatcccaaaaagtgcgtcccagtccggattgcagtctgcaactcgactgcatgaagttggaatcgctagtaattcgagatcagcatgctcgggtgaatgcgttcccgggccttgtacacaccgcccgtcacaccacgaaagttggttttacccgacaccggtgagctaaccagcaatggaggcagccgtctacggtagggccgatgattggggtgaagtcgtaacaaggtagccgtaggggaacctgcggctggatcacctccttt

SEQ ID NO: 762 - DNA, 965 bp, Dialister invisus
  modified_base (9)..(10): a, c, t, g, unknown or other
  modified_base (12)..(12): a, c, t, g, unknown or other
  modified_base (16)..(17): a, c, t, g, unknown or other
  modified_base (20)..(22): a, c, t, g, unknown or other
  modified_base (43)..(49): a, c, t, g, unknown or other
  modified_base (700)..(700): a, c, t, g, unknown or other
  modified_base (716)..(716): a, c, t, g, unknown or other
  modified_base (785)..(785): a, c, t, g, unknown or other
  modified_base (940)..(940): a, c, t, g, unknown or other
  modified_base (944)..(944): a, c, t, g, unknown or other
  modified_base (954)..(954): a, c, t, g, unknown or other
gaaaagacnnanagannttnnncttttcagaattgagtggcannnnnnngagtaacacgtaaacaacctgccttcaggatggggacaacagacggaaacgactgctaataccgaataagttccaagagccgcatggcccatggaagaaaaggtggcctctacctgtaagctatcgcctgaagaggggtttgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacnaaaaactgacgctgangcgcgaaagcgtggggagcaaacaggattagataccctggtagtccacgccgtaaacgatggatactangtgtaggaggtatcgacccctcctgtgccggagttaacgcaataagtatcccgcctgggaaagtacgatcgcaagattaaaactcaaaggaattgacgggggcccgcacaagcggtggagtatgtggtttaattcgacgcaacgcgaagaacctnaccnggtcttgacnttgatcgcgat

SEQ ID NO: 763 - DNA, 1565 bp, Dialister micraerophilus
tggagagtttgatcctggctcaggacgaacgctggcggcgtgcttaacacatgcaagtcgaacgagaggacatgaaaagcttgctttttatgaaatctagtggcaaacgggtgagtaacacgtaaacaacctgccttcaagatggggacaacagacggaaacgactgctaataccgaatacgatccgaaagtcgcatgacatttggatgaaagggtggcctatcgaagaagctatcgcttgaagaggggtttgcgtccgattaggtagttggtgaggtaacggcccaccaagccgacgatcggtagccggtctgagaggatgaacggccacactggaactgagacacggtccagactcctacgggaggcagcagtggggaatcttccgcaatggacgaaagtctgacggagcaacgccgcgtgagtgaagacggccttcgggttgtaaagctctgtgattcgggacgaaaggccatatgtgaataatatatggaaatgacggtaccgaaaaagcaagccacggctaactacgtgccagcagccgcggtaatacgtaggtggcaagcgttgtccggaattattgggcgtaaagcgcgcgcaggcggtcacttaagtccatcttagaagtgcggggcttaaccccgtgatgggatggaaactgggagactggagtatcggagaggaaagtggaattcctagtgtagcggtgaaatgcgtagatattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgaccccttctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaagtcttgacattgatcgccattccaagagattggaagttctccttcgggagacgagaaaacaggtggtgcacggctgtcgtcagctcgtgtcgtgagatgttgggttaagtcccgcaacgagcgcaacccctatcttttgttgccagcacgtagaggtgggaactcagaagagaccgccgcagacaatgcggaggaaggtggggatgacgtcaagtcatcatgccccttatgacttgggctacacacgtactacaatgggctttaacaaagagcagcgaaaccgcgaggtggagcgaaactcaaaaacaagcccccagttcagatcgcaggctgcaactcgcctgcgtgaagcaggaatcgctagtaatcgcgggtcagcataccgcggtgaatacgttcccgggccttgtacacaccgcccgtcacactatgagagtcggaaacacccgaagccggtgaggtaaccgcaaggagccagccgtcgaaggtggggctgatgattggagtgaagtcgtaacaaggtagccgtatcggaaggtgcggctggatcacctcctttct

SEQ ID NO: 764 - DNA, 1328 bp, Dialister microaerophilus
tggagagtttgatcctggctcaggacgaacgctggcggcgtgcttaacacatgcaagtcgaacgagaggacatgaaaagcttgctttttatgaaatctagtggcaaacgggtgagtaacacgtaaacaacctgccttcaagatggggacaacagacggaaacgactgctaataccgaatacgatccgaaagtcgcatgacatttggatgaaagggtggcctatcgaagaagctatcgcttgaagaggggtttgcgtccgattaggtagttggtgaggtaacggcccaccaagccgacgatcggtagccggtctgagaggatgaacggccacactggaactgagacacggtccagactcctacgggaggcagcagtggggaatcttccgcaatggacgaaagtctgacggagcaacgccgcgtgagtgaagacggccttcgggttgtaaagctctgtgattcgggacgaaaggccatatgtgaataatatatggaaatgacggtaccgaaaaagcaagccacggctaactacgtgccagcagccgcggtaatacgtaggtggcaagcgttgtccggaattattgggcgtaaagcgcgcgcaggcggtcacttaagtccatcttagaagtgcggggcttaaccccgtgatgggatggaaactgggagactggagtatcggagaggaaagtggaattcctagtgtagcggtgaaatgcgtagatattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgaccccttctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaagtcttgacattgatcgccattccaagagattggaagttctccttcgggagacgagaaaacaggtggtgcacggctgtcgtcagctcgtgtcgtgagatgttgggttaagtcccgcaacgagcgcaacccctatcttttgttgccagcacgtagaggtgggaactcagaagagaccgccgcagacaatgcggaggaaggtggggatgacgtcaagtcatcatgccccttatgacttgggctacacacgtactacaatgggctttaacaaagagcagcgaaaccgcgaggtggagcgaaactcaaaaacaagcccccagttcagat

SEQ ID NO: 765 - DNA, 1547 bp, Dialister pneumosintes
gagtttgatcctggctcaggacgaacgctggcggcgtgcttaacacatgcaagtcgaacggaaagagatgaaagagcttgctcttttattaatttcagtggcaaacgggtgagtaacacgtaaacaacctgccttaaggatggggataacagacggaaacgactgctaataccgaatacgttctaagcatcgcatggtgcatagaagaaagggtggcctctacaagaaagctatcgccttaagaggggtttgcgactgattaggtagttggtgaggtaacggctcaccaagccgacgatcagtagccggtctgagaggatgaacggccacactggaactgagacacggtccagactcctacgggaggcagcagtggggaatcttccgcaatggacgaaagtctgacggagcaacgccgcgtgaacgaagaaggtcttcggattgtaaagttctgtgattcgggacgaaagggtttgtggtgaataatcatagacattgacggtaccgaaaaagcaagccacggctaactacgtgccagcagccgcggtaatacgtaggtggcaagcgttgtccggaattattgggcgtaaagcgcgcgcaggcggtttcttaagtccatcttaaaagcgtggggctcaaccccatgaggggatggaaactgggaagctggagtatcggagaggaaagtggaattcctagtgtagcggtgaaatgcgtagagattaggaagaacaccggtggcgaaggcgactttctagacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaagccttgacattgatcgcaatccatagaaatatggagttcttcttcggaagacgagaaaacaggtggtgcacggctgtcgtcagctcgtgtcgtgagatgttgggttaagtcccgcaacgagcgcaacccctatttcctgttaccagcacgtaaaggtggggactcaggagagaccgccgcggacaacgcggaggaaggcggggatgacgtcaagtcatcatgccccttatggcttgggctacacacgtactacaatgggtgccaacaaagagaagcgaaatcgcgagatggagcggacctcataaacgcacccccagttcagattgcaggctgcaactcgcctgcatgaagtaggaatcgctagtaatcgcgggtcagcataccgcggtgaatacgttcccgggccttgtacacaccgcccgtcacactatgagagttagagacacccgaagccggtgaggtaaccgcaagggaccagccgtctaaggtggagctgatgattggagtgaagtcgtaacaaggtagccgtatcggaaggtgcgg

SEQ ID NO: 766 - DNA, 1396 bp, Dialister propionicifaciens
aaaagactgctcttttcgatccagtggcaaacgggtgagtaacacgtaaacaacctgccttcaggatggggacaacagacggaaacgactgctaataccgaatacgttccacgggccgcatgacctgtggaagaaagggtagcctctacctgtaagctatcgcctgaagaggggtttgcgtctgattaggcagttggtggggtaacggcccaccaaaccaacgatcagtagccggtctgagaggatgaacggccacactggaactgagacacggtccagactcctacgggaggcagcagtggggaatcttccgcaatggacgaaagtctgacggagcaacgccgcgtgagtgaagacggccttcgggttgtaaagctctgtgatccgggacgaaagagcctgaggttaatagcctaaggaagtgacggtaccggaaaagcaagccacggctaactacgtgccagcagccgcggtaatacgtaggtggcaagcgttgtccggaattattgggcgtaaagcgcgcgcaggcggcttcctaagtccatcttaaaagtgcggggcttaaccccgtgatgggatggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgaccccttctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcaattttcagaaatgagaagttctccttcgggagacgagaaaacaggtggtgcacggctgtcgtcagctcgtgtcgtgagatgttgggttaagtcccgcaacgagcgcaacccctatcatttgttgccagcacgtaaaggtggggactcaaatgagaccgccgcagacaatgcggaggaaggtggggatgacgtcaagtcatcatgccccttatgacctgggctacacacgtactacaatgggtgtcaacaaagagaagcgaaagggcgacctggagccaacctcaaaaacacacccccagttcagatcgcaggctgcaactcgcctgcgtgaagcaggaatcgctagtaatcgcgggtcagcataccgcggtgaatacgttcccgggccttgtacacaccgcccgtcacactatgagagtcagaaacacccgaagccggtgaggtaacc

SEQ ID NO: 767 - DNA, 1547 bp, Dialister sp.
  oral taxon 502
gagtttgatcctggctcaggacgaacgctggcggcgtgcttaacacatgcaagtcgaacggaaagagatgaaagagcttgctcttttattaatttcagtggcaaacgggtgagtaacacgtaaacaacctgccttagggatggggataacagacggaaacgactgctaataccgaatacgttctaagcatcgcatgatgcatagaagaaagggtggcctctacaagaaagctatcgccttaagaggggtttgcgactgattaggtagttggtgaggtaacggctcaccaagccgacgatcagtagccggtctgagaggatgaacggccacactggaactgagacacggtccagactcctacgggaggcagcagtggggaatcttccgcaatggacgaaagtctgacggagcaacgccgcgtgaacgaagaaggtcttcggattgtaaagttctgtgattcgggacgaaagggtaaatagtgaataactatagacattgacggtaccgaaaaagcaagccacggctaactacgtgccagcagccgcggtaatacgtaggtggcaagcgttgtccggaattattgggcgtaaagcgcgcgcaggcggtttcttaagtccatcttaaaagcgtggggctcaaccccatgaggggatggaaactgggaagctggagtatcggagaggaaagtggaattcctagtgtagcggtgaaatgcgtagagattaggaagaacaccggtggcgaaggcgactttctagacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagagccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctgtcatttgttgccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaacccgcgagggagagcaaagctcaaaaacacacccccagttcagatcgcaggctgcaacccgcctgcgtgaagtaggaatcgctagtaatcgcgggtcagcataccgcggtgaatacgttcccgggccttgtacacaccgcccgtcacactatgagagtcagaaacacccgaagccggtgaggtaaccgcaaggagccagccgtcgaaggcggagctgatgattggagtgaagtcgtaacaaggtagccgtatcggaaggtgcgg

SEQ ID NO: 768 - DNA, 1325 bp, Dialister succinatiphilus
gacgaacgctggcggcgtgcttaacacatgcaagtcgaacgagtggcaaacgggtgagtaacacgtaaacaacctgccttcaggatggggacaacagacggaaacgactgctaataccgaatacggaaagtcgcctgaagaggggtttgcgtctgattaggcagttggtgaggtaacggcccaccaaacctacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgatcggggacgatgacggtacccgaatagcaagccacggctaactacgtgccagcagccgcggtaatacgtaggtggcaagcgttgtccggaattattgggcgtaaagcgcgcgcaggcggctttctaagtccatcttaaaagtgcggggcttaaccccgtgatgggatggaaactgggaagctggagtatcggagaggaaagtggaattcctagtgtagcggtgaaatgcgtagagattaggaagaacaccggtggcgaaggcgactttctggacgaactgacgctgaggcgcgaaagcgtggggagcaaacaggattagataccctggtagtccacgccgtaaacgatgaatactaggtgtaggagcttctgtgccggagctaacacaataagtattccgcctgggaagtacgatcgcaagattaaaactcaaaggaattgacgggggcccgcacaagcggtggagtatgtggtttaattcgacgcaacgcgaagaaccttaccaggtcttgacattaacaggtggtgcacggctgtcgtcagctcgtgtcgtgagatgttgggttaagtcccgcaacgagcgcaacccctatcttatgttaccagcacgtggggactcatgagagaccgccgcggacaacgcggaggaaggtggggatgacgtcaagtcatcatgccccttatgacctgggctacacacgtactacaatgggtgtcaaagagaagcgaaaccgcgaggtggagcgaacctcaacacccccagttcagatgcaggctgcaacccgcctgcagaagtaggaatcgctagtaatcgcgggtcagcataccgcggtgaatacgttcccgggccttgtacacaccgcccgtcacactatgagagtcggaaacacccgaagccggtaggtagccagccgtcgaaggtggagctgatgattggagtgaagtcgtaacaaggtagccgtatcggaagg

SEQ ID NO: 769 - DNA, 1433 bp, Dietzia natronolimnaea
gcttacacatgcagtcgaacggtaaggccctttcgggggtacacgagtggcgaacgggtgagtaacacgtgggtaatctgccctgcacttcgggataagcctgggaaaccgggtctaataccggatatgagctcctgccgcatggtgggggttggaaagtttttcggtgcaggatgagtccgcggcctatcagcttgttggtggggtaatggcctaccaaggcgacgacgggtagccggcctgagagggtgatcggccacactgggactgagacacggcccagactcctacgggaggcagcagtggggaatattgcacaatgggcgaaagcctgatgcagcgacgccgcgtgggggatgacggtcttcggattgtaaactcctttcagtagggacgaagcgaaagtgacggtacctgcagaagaagcaccggccaactacgtgccagcagccgcggtaatacgtagggtgcaagcgttgtccggaattactgggcgtaaagagctcgtaggcggtttgtcacgtcgtctgtgaaatcctccagctcaactgggggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcatggggagcaaacaggattagataccctggtagtccatgccgtaaacggtgggcgctaggtgtggggtccttccacggattccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctaggcttgacatatacaggacgacggcagagatgtcgtttcccttgtggcttgtatacaggtggtgcatggttgtcgtcagctcgtgtcgtgagatgttgggttaagtcccgcaacgagcgcaacccctgtctcatgttgccagcacgttatggtggggactcgtgagagactgccggggtcaactccggatgaaggtggggatgacgtcaaatcatcatgcccccttatgtctagggcttcacatatgctacaatggctagtacagagggctgcgagaccgcgaggtggagcgaatcccttaaagctagtctcagttcggattggggtctgcaactcgaccccatgaagtcggagtcgctagtaatcgcagatcagcattgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgaacaag

SEQ ID NO: 770 - DNA, 1483 bp, Dietzia sp.
  BBDP51
agagtttgatcctggctcaggacgaacgctggcggcgtgcttaacacatgcaagtcgaacggtaaggcccttcggggtacacgagtggcgaacgggtgagtaacacgtgggtaatctgccctgcacttcgggataagcctgggaaactgggtctaataccggatatgaactcctgccgcatggtgggggttggaaagtttttcggtgcaggatgagtccgcggcctatcagcttgttggtggggtaatggcctaccaaggcgacgacgggtagccggcctgagagggtgatcggccacactgggactgagacacggcccagactcctacgggaggcagcagtggggaatattgcacaatgggcgaaagcctgatgcagcgacgccgcgtgggggatgacggtcttcggattgtaaacccctttcagtagggacgaagcgcaagtgacggtacctgcagaagaagcaccggctaactacgtgccagcagccgcggtaatacgtagggtgcgagcgttgtccggaattactgggcgtaaagagctcgtaggcggtttgtcacgtcgtctgtgaaatccctcggcttaaccgggggcgtgcaggcgatacgggcagacttgagtactacaggggagactggaattcctggtgtagcggtgaaatgcgcagatatcaggaggaaccaccggtggcgaagggcgggtctcttgggtagtaactgacgctgaggagcgaaaagcatgggttagcgaacaggattagataccctgggtagtccatgccgtaaaacggtgggcgctaggtgtggggtccttccacggattccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctaggcttgacatatacaggacgacggcagagatgtcgtttcccttgtggcttgtatacaggtggtgcatggttgtcgtcagctcgtgtcgtgagatgttgggttaagtcccgcaacgagcgcaacccctgtctcatgttgccagcacgttatggtggggactcgtgagagactgccggggtcaactcggaggaaggtggggatgacgtcaaatcatcatgccccttatgtctagggcttcacacatgctacaatggctagtacagagggctgcgataccgcgaggtggagcgaatcccttaaagctggtctcagttcggattggggtctgcaactcgaccccatgaagtcggagtcgctggtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtaacc

SEQ ID NO: 771 - DNA, 1467 bp, Dietzia sp.
  CA149
ttaactgcagtcgacggtaaggccccttcgggggtacacgagtggcgaacgggtgagtaacacgtgggtaatctgccctgcacttcgggataagcttgggaaactgggtctaataccggatatgaactcctgccgcatggtgggggttggaaagtttttcggtgcaggatgagcccgcggcctatcagcttgttggtggggtaatggcctaccaaggcgacgacgggtagccggcctgagagggtgatcggccacactgggactgagacacggcccagactcctacgggaggcagcagtggggaatattgcacaatgggcgaaagcctgatgcagcgacgccgcgtgggggatgacggtcttcggattgtaaacccctttcagtagggacgaagcgcaagtgacggtacctgcagaagaagcaccggctaactacgtgccagcagccgcggtaatacgtagggtgcgagcgttgtccggaattactgggcgtaaagagctcgtaggcggtttgtcacgtcgtctgtgaaatccctcggcttaaccgggggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcatgggtagcgaacaggattagataccctggtagtccatgccgtaaacggtgggcgctaggtgtggggtccttccacggactccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctaggcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtaaatcagcatgctacggtgaatacgttcccgggtcttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcaaatccataa

SEQ ID NO: 772 - DNA, 1472 bp, Dietzia timorensis
ggggtgcttacacatgcagtcgaacggtaaggcccttcggggtacacgagtggcgaacgggtgagtaacacgtgggtaatctgccctgcacttcgggataagcctgggaaactgggtctaataccggatattcagcttctgccgcatggtggttgttggaaagtttttcggtgcaggatgtgcccgcggcctatcagcttgttggtggggtaatggcctaccaaggcgacgacgggtagccggcctgagagggtgatcggccacattgggactgagacacggcccagactcctacgggaggcagcagtggggaatattgcacaatgggcgcaagcctgatgcagcgacgccgcgtgagggatgacggtcttcggattgtaaacctctttcggcagggacgaagcgcaagtgacggtacctgcagaagaagcaccggccaactacgtgccagcagccgcggtaatacgtagggtgcaagcgttgtccggaattactgggcgtaaagagctcgtaggcggtttgtcgcgtcgtctgtgaaatcctacagcttaactgtgggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcatgggtagcgaacaggattagataccctggtagtccatgccgtaaacggtgggcgctaggtgtgggtttccttccacgggatccgtgccgcagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggacgacggcagagatgtcgtttcccttgtggcttgtatacaggtggtgcatggttgtcgtcagctcgtgtcgtgagatgttgggttaagtcccgcaacgagcgcaacccttgtctcatgttgccagcaattcggttggggactcgtgagagactgccggggtcaactcggaggaaggtggggatgacgtcaaatcatcatgccccttagtccagggcttcacacatgctacaatggccggtacagagggctgcgatactgtaaagtggagcgaatctcttaaagccggtctcagttcggattggggtctgcaactcgaccccatgaagtcgagtcgctagtaatcgcagatcagcaatgctgcggtgaatacgttcccgggccttgtacacaccgcccgtcacgtcatgagagtcggtaacacccgaagccggtggcctaacccttgtggggggagccgtcgaaggtgggatcggcgattgggacgaagtcgtaacaaggtacccgtaccggagggtgcggctggatcaaatcaata

SEQ ID NO: 773 - DNA, 1392 bp, Dorea formicigenerans
gtcgagcgaagcacttaagtttgattcttcggatgaagacttttgtgactgagcggcggacgggtgagtaacgcgtgggtaacctgcctcatacagggggataacagttagaaatggctgctaataccgcataagaccacagtactgcatggtacagtggtaaaaactccggtggtatgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatgggcgaaagcctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggctgtgcaagtctgaagtgaaaggcatgggctcaacctgtggactgctttggaaactgtgcagctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggtagcaaagctattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagcttttcttcggaacatcggtgacaggtggtgcatggttgtcgtcagctcgtgtcgtgagatgttgggttaagtcccgcaacgagcgcaacccttatcttcagtagccagcatttaggatgggcactctggagagactgccagggataacctggaggaaggtggggatgacgtcaaatcatcatgccccttatgaccagggctacacacgtgctacaatggcgtaaacaaagggaagcagagccgcgaggccgagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgaaaggagggagct

SEQ ID NO: 774 - DNA, 1392 bp, Dorea longicatena
  modified_base (13)..(13): a, c, t, g, unknown or other
  modified_base (18)..(19): a, c, t, g, unknown or other
  modified_base (21)..(22): a, c, t, g, unknown or other
  modified_base (24)..(25): a, c, t, g, unknown or other
  modified_base (41)..(41): a, c, t, g, unknown or other
gtcgagcgaagcngcttnngnnannagattcttcggatganttcctttgtgactgagcggcggacgggtgagtaacgcgtgggtaacctgcctcatacagggggataacagttagaaatgactgctaataccgcataagaccacggtaccgcatggtacagtggtaaaaactccggtggtatgagatggacccgcgtctgattaggtagttggtggggtaacggcctaccaagccgacgatcagtagccgacctgagagggtgaccggccacattgggactgagacacggcccagactcctacgggaggcagcagtggggaatattgcacaatggaggaaactctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcacggcaagccagatgtgaaagcccggggctcaaccccgggactgcatttggaactgctgagctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactgctaggtgtcgggtggcaaagccattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacttcccgatgaccgcttcgtaatggaagtctttcttcggaacatcggtgacagtgggggcatggatgtcgtcagctcgtgtcgtgagatgttgggttaagtcccgcaacgagcgcaacccctatcttcagtagccagcaggttaagctgggcactctggagagactgccagggataacctggaggaaggtggggatgacgtcaaatcatcatgccccttatgaccagggctacacacgtgctacaatggcgtaaacaaagagaagcgaactcgcgagggtaagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgtaaggagg

SEQ ID NO: 775 - DNA, 1529 bp, Dysgonomonas gadei
acaaagaagagtttgatcctggctcaggatgaacgctagcgataggcctaacacatgcaagtcgaggggcagcatagggtagcaatactttgatggcgaccggcgcacgggtgagtaacgcgtatgcaacctacctataacaggggaataacccggagaaattcggactaataccgcataaaacaggggctccgcatggagatatttgttaaagatttatcggttatagatgggcatgcgttccattagccagttggtgaggtaacggctcaccaaagcaacgatggataggggaactgagaggtttgtcccccacactggaactgagacacggaccagactcctacgggaggcagcagtgaggaatattggtcaatgggcgagagcctgaaccagccaaatcgcgtgaaggaagactgccttatgggttgtaaacttcttttatacaggaataaaaagagttacgtgtaacttattgcatgtactgtatgaataagcatcggctaactccgtgccagcagccgcggtaatacggaggatgcgagcgttatccggatttattgggtttaaagggtgcgcaggcgggaacttaagtcagcggtgaaatctcgacgcttaacgtcgaaactgccgttgaaactgggtttcttgagtatagatgaagtaggcggaattcgttgtgtagcggtgacatgcttagatataacgaggaactccgattgcgtaggcagcttactaagctataactgacgctcaagcacgaaagcgtggggatcaaacaggattagataccctggtagtccacgccgtaaacgatgattactagttgtatgcgatataccgtatgtgactaagcgaaagcgataagtaatccacctggggagtacgccggcaacggtgaaactcaaaggaattgacgggggcccgcacaagcggaggaacatgtggtttaattcgatgatacgcgaggaaccttacccgggcttgaaatgcagaagaataacgttgaaagatgttagccagcaatggcttctgtgtaggtgctgcatggttgtcgtcagctcgtgccgtgaggtgtcggcttaagtgccataacgagcgcaacccacattgttagttactaacaggtcaagctgaggactctaacaagactgccgtcgtaagatgcgaggaaggtgtggatgacgtcaaatcagcacggcccttacgtccggggcgacacacgtgttacaatgggtggtacaaagggcagctacttggtgacaagatgctaatctccaaagccactcccagttcggatcggagtctgcaactcgactccgtgaagctggattcgctagtaatcgcgcatcagccatggcgcggtgaatacgttcccgggccttgtacacaccgcccgtcaagccatggaagctgggggtatctgaagtgcgtaaccgcaaggagcgtcctagggtaaaaccggtgactggggctaagtcgtaacaaggtagccgtaccggaaggtgcggctggaacacctcctttct

SEQ ID NO: 776 - DNA, 1003 bp, Dysgonomonas mossii
  modified_base (879)..(879): a, c, t, g, unknown or other
  modified_base (972)..(974): a, c, t, g, unknown or other
  modified_base (979)..(981): a, c, t, g, unknown or other
  modified_base (991)..(992): a, c, t, g, unknown or other
agtcgaggggcagcatagagtagcaatactttgatggcgaccggcgcacgggtgagtaacacgtatgcaacctacctacatcaggggaataacccggagaaattcggactaataccgcataatacagggatgccgcatggcaatatttgttaaagatttatcggatgtagatgggcatgcgttccattagctagttggtaaggtaacggcttaccaaggcaacgatggataggggaactgagaggtttgtcccccacactggaactgagacacggaccagactcctacgggaggcagcagtgaggaatattggtcaatggacgagagtctgaaccagccaaatcgcgtgaaggaagactgccctacgggttgtaaacttcttttgtacaggaataaaagacattacgtgtaatgtattgcatgtactgtacgaataagcatcggctaactccgtgccagcagccgcggtaatacggaggatgcgagcgttatccggatttattgggtttaaagggtgcgcaggcgggattttaagtcagcggtgaaattttcaggctcaacctgaacactgccgttgaaactgggattcttgagtatggatgaagtaggcggaattcgttgtgtagcggtgacatgcttagatataacgaggaactccgattgcgtaggcagcttactaagccataactgacgctcaagcacgaaagcgtggggatcaaacaggattagataccctggtagtccacgccgtaaacgatgattactagttgtttgcgatataccgtaagtgactaagcgaaagcgataagtaatccacctggggagtacgccggcaacggtgaaactcaaaggaattgacgggggcccgcacaagcggangaacatgtggtttaattcgatgatacgcgaggaaccttacccgggcttgaaatgtacctgaccgtccttgaaaagggacttctagcaatagcnnnatgtnnngctgcatggnngtcgtcagctc

SEQ ID NO: 777 - DNA, 1547 bp, Edwardsiella tarda
tttaattgaagagtttgatcatggctcagattgaacgctggcggcaggcttaacacatgcaagtcgagcggtagcagggagaaagcttgctttctccgctgacgagcggcggacgggtgagtaatgtctggggatctgcctgatggagggggataactactggaaacggtagctaataccgcataacgtcgcaagaccaaagtgggggaccttcgggcctcatgccatcagatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtagggaggaaggtgtgaacgttaatagcgctcacaattgacgttacctacagaagaagcaccggctaactccgtgccagcagccgcggtaatacggagggtgcaagcgttaatcggaattactgggcgtaaagcgcacgcaggcggtttgttaagttggatgtgaaatccccgggcttaacctgggaactgcatccaagactggcaagctagagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgctgtaaacgatgtcgatttggaggttgtgcccttgaggcgtggcttccgaagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctgtagagatacgggagtgccttcgggaacgctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgaactcgcgagagcaagcggacctcataaagtacgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 778 - DNA, 999 bp, Eggerthella lenta
  modified_base (33)..(36): a, c, t, g, unknown or other
  modified_base (57)..(57): a, c, t, g, unknown or other
  modified_base (119)..(119): a, c, t, g, unknown or other
  modified_base (788)..(788): a, c, t, g, unknown or other
  modified_base (848)..(848): a, c, t, g, unknown or other
  modified_base (860)..(860): a, c, t, g, unknown or other
  modified_base (877)..(877): a, c, t, g, unknown or other
  modified_base (887)..(887): a, c, t, g, unknown or other
  modified_base (891)..(891): a, c, t, g, unknown or other
  modified_base (899)..(899): a, c, t, g, unknown or other
  modified_base (933)..(934): a, c, t, g, unknown or other
  modified_base (961)..(961): a, c, t, g, unknown or other
  modified_base (963)..(963): a, c, t, g, unknown or other
  modified_base (978)..(978): a, c, t, g, unknown or other
  modified_base (980)..(980): a, c, t, g, unknown or other
  modified_base (983)..(983): a, c, t, g, unknown or other
cctcgggcggacatgaagtggcgaacgggtgannnncacgtgaccaacctgcccccngctccgggacaaccttgggaaaccgaggctaataccggatactccctcccctgctcctgggngggtcgggaaagcccaggcggagggggatggggtcgcggcccattaggtagtaggcggggtaacggcccacctagcccgcgatgggtagccgggttgagagaccgaccggccacattgggactgagatacggcccagactcctacgggaggcagcagtggggaattttgcgcaatgggggaaaccctgacgcagcaacgccgcgtgcgggacgacggccttcgggttgtaaaccgctttcagcagggaagaaattcgacggtacctgcagaagaagctccggctaactacgtgccagcagccgcggtaatacgtagggagcgagcgttatccggattcattgggcgtaaagagcgcgtaggcggcctctcaagcgggatctctaatccgagggctcaacccccggccggatcccgaactgggaggctcgagttcggtagaggcaggcggaattcccggtgtagcggtggaatgcgcagatatcgggaagaacaccgatggcgaaggcagcctgctgggccgcaactgacgctgaggcgcgaaagctaggggagcgaacaggattagataccctggtagtcctagccgtaaacgatggatactaggtgtggggggctccgccctccgtgccgcagccaacgcattaagtatcccgcctggggagtacggncgcaaggctaaaactcaaggaattgacgggggcccgcacaagcagcggagcatgtggctnaattcgaagcancgcgaagaaccttaccngggcttgacntggnacgtgaanccggggaaacccggtggccgagaggagcgtccgnnagtggtgcatggctgtcgtcagctcgngncgtgagatgttgggntnagntcccgcaacgagcgca

SEQ ID NO: 779 - DNA, 1429 bp, Eggerthella sinensis
gatgaacgctggcggcgtgcctaacacatgcaagtcgaacgattaaaccgtcctcggacggacatagagtggcgaacgggtgagtaacacgtgaccaacctgccccccgctccgggacaaccttgggaaaccgaggctaataccggatactcctcgcccccctcctggggggcccgggaaagcccagacggcgggggatggggtcgcggcccattaggtagacggcggggtaacggcccaccgtgcctgcgatgggtagccgggttgagagaccgaccggccacattgggactgagatacggcccagactcctacgggaggcagcagtggggaattttgcgcaatgggggaaaccctgacgcagcaacgccgcgtgcgggatgacggccttcgggttgtaaaccgctttcagcagggaagaaattcgacggtacctgcagaagaagctccggctaactacgtgccagcagccgcggtaatacgtagggagcgagcgttatccggattcattgggcgtaaagagcgcgtaggcggcctttcaagcgggatctctaatccgagggctcaacccccggccggatcccgaactgggaggctcgagttcggtagaggcaggcggaattcccggtgtagcggtggaatgcgcagatatcgggaagaacaccgatggcgaaggcagcctgctgggccgaaactgacgctgaggcgcgaaagctaggggagcgaacaggattagataccctggtagtcctagccgtaaacgatgggcgctaggtgtggggagggtcatcctctccgtgcccgcagctaacgcattaagcgccccgcctggggagtacggccgcaaggctaaaactcaaaggaattgacgggggcccgcacaagcagcggagcatgtggcttaattcgaagcaacgcgaagaaccttaccagggcttgacatgctagtgaagccggggaaacccggtggccgagaggagctagcgcaggtggtgcatggctgtcgtcagctcgtgtcgtgagatgttgggttaagtcccgcaacgagcgcaacccctatcgcatgttgccagcattcagttggggactcatgcgagactgccggcgtcaagccggaggaaggtggggacgacgtcaagtcatcatgccctttatgccctgggctgcacacgtgctacaatggccggtacaacgggctgcgaactcgcgagagtgagcgaatcccttaaagccggccccagttcggatcggaggctgcaacccgcctccgtgaagtcggagttgctagtaatcgcggatcagcatgccgcggtgaatacgttcccgggccttgtacacaccgcccgtcacaccacccgagtcgtctgcacccgaagccgccggccgaacccgcaaggggcggaggcgtcgaaggtgtggagggtaaggg

SEQ ID NO: 780 - DNA, 1346 bp, Eggerthella sp.
  1_3_56FAA
  modified_base (123)..(123): a, c, t, g, unknown or other
  modified_base (1329)..(1329): a, c, t, g, unknown or other
accgccctcgggcggacatgaagtggcgaacgggtgagtaacacgtgaccaacctgcccccctctccgggacaaccttgggaaaccgaggctaataccggatactccctcccctgctcctggnggggtcgggaaagcccaggcggagggggatggggtcgcggcccattaggtagtaggcggggtaacggcccacctagcccgcgatgggtagccgggttgagagaccgaccggccacattgggactgagatacggcccagactcctacgggaggcagcagtggggaattttgcgcaatgggggaaaccctgacgcagcaacgccgcgtgcgggacgacggccttcgggttgtaaaccgctttcagcagggaagaaattcaggcctgcagaagaagctccggctaactacgtgccagcagccgcggtaatacgtagggagcgagcgttatccggattcattgggcgtaaagagcgcgtaggcggcctctcaagcgggatctctaatccgagggctcaacccccggccggatcccgaactgggaggctcgagttcggtagaggcaggcggaattcccggtgtagcggtggaatgcgcagatatcgggaagaacaccgatggcgaaggcagcctgctgggccgcaactgacgctgaggcgcgaaagctaggggagcgaacaggattagataccctggtagtcctagccgtaaacgatggatactaggtgtggggggctccgccctccgtgccgcagccaacgcattaagtatcccgcctggggagtacggccgcaaggctaaaactcaaaggaattgacgggggcccgcacaagcagcggagcatgtggcttagttcgaagcaacgcgaagaacctcaccaggcctgatcccgaactggaagccggggaaacccggtggccgagaggaacgtccgcaggtggtgcatggctgtcgtcagctcgtgtcgtgacatgttgggttaagtcccgcaacgagcgcaacccctgccccatgttgccagcattaggttggggactcatgggggactgccggcgtcaagccggaggaaggtggggacgacgtcaagtcatcatgccctttatgccctgggctgcacacgtgctacaatggccggtacaacgggctgcgagaccgcgaggtcgagcgaatccctcaaagccggccccagttcggatcggaggctgcaacccgcctccgtgaagtcggagttgctagtaatcgcggatcagcatgccgcggtgaatacgttcccgggccttgtacacaccgcccgtcacaccacccgagtcgtctgcacccgaagccgccntccgaacccgcaagggg

SEQ ID NO: 781 - DNA, 1430 bp, Eggerthella sp.
  HGA1
gaacgctggcggcgtgcctaacacatgcaagtcgaacgatgaaaccgccctcgggcggacatgaagtggcgaacgggtgagtaacacgtgaccaacctgcccccctctccgggacaaccttgggaaaccgaggctaataccggatactccctcccctgctcctgcaggggtcgggaaagcccaggcggagggggatggggtcgcggcccattaggtagtaggcggggtaacggcccacctagcccgcgatgggtagccgggttgagagaccgaccggccacattgggactgagatacggcccagactcctacgggaggcagcagtggggaattttgcgcaatgggggcaaccctgacgcagcaacgccgcgtgcgggacgacggccttcgggttgtaaaccgctttcagcagggaagaaattcgacggtacctgcagaagaagctccggctaactacgtgccagcagccgcggtaatacgtagggagcgagcgttatccggattcattgggcgtaaagagcgcgtaggcggcctctcaagcgggatctctaatccgagggctcaacccccggccggatcccgaactgggaggctcgagttcggtagaggcaggcggaattcccggtgtagcggtggaatgcgcagatatcgggaagaacaccgatggcgaaggcagcctgctgggccgcaactgacgctgaggcgcgaaagctaggggagcgaacaggattagataccctggtagtcctagccgtaaacgatggatactaggtgtggggggctccgccctccgtgccgcagccaacgcattaagtatcccgcctggggagtacggccgcaaggctaaaactcaaaggaattgacgggggcccgcacaagcagcggagcatgtggcttaattcgaagcaacgcgaagaaccttaccagggcttgacatggacgtgaagccggggaaacccggtggccgagaggagcgtccgcaggtggtgcatggctgtcgtcagctcgtgtcgtgagatgttgggttaagtcccgcaacgagcgcaacccctgccccatgttgccagcattaggttggggactcatgggggactgccggcgtcaagccggaggaaggtggggacgacgtcaagtcatcatgccctttatgccctgggctgcacacgtgctacaatggccggtacaacgggctgcgagaccgcgaggtcgagcgaatccctcaaagccggccccagttcggatcggaggctgcaacccgcctccgtgaagtcggagttgctagtaatcgcggatcagcatgccgcggtgaatacgttcccgggccttgtacacaccgcccgtcacaccacccgagtcgtctgcacccgaagccgccggccgaacccgcaaggggcggaggcgtcgaaggtgtggagggtaaggggggtgaa

SEQ ID NO: 782 - DNA, 753 bp, Eggerthella sp.
  YY7918
  modified_base (122)..(122): a, c, t, g, unknown or other
  modified_base (197)..(197): a, c, t, g, unknown or other
  modified_base (341)..(341): a, c, t, g, unknown or other
  modified_base (431)..(431): a, c, t, g, unknown or other
  modified_base (508)..(508): a, c, t, g, unknown or other
  modified_base (602)..(602): a, c, t, g, unknown or other
  modified_base (620)..(621): a, c, t, g, unknown or other
  modified_base (623)..(623): a, c, t, g, unknown or other
  modified_base (627)..(627): a, c, t, g, unknown or other
  modified_base (670)..(670): a, c, t, g, unknown or other
  modified_base (676)..(676): a, c, t, g, unknown or other
  modified_base (709)..(709): a, c, t, g, unknown or other
  modified_base (739)..(739): a, c, t, g, unknown or other
ctacccttctcttcgggacaaccttgggaaaccgaggctaataccgaatactccggtgagtgcgcatgcacacgccgggaaagctttcgcggagaaggatggggtcgcggcccatcaggtanacggcggggtagcggcccaccgtgcttttgacgggtagccgggttgagagaccgaccggccacattgggactganatacggcccagactcctacgggaggcagcagtggggaattttgcgcaatgggggaaaccctgacgcagcaccgccgcgtgcgggatgaaggccttcgggtcgtaaaccgctttcagcagggaagaaattcgacggtacctgcanaagaagccccggctaactacgtgccagcagccgcggtaatacgtagggggcgagcgttatccggattcattgggcgtaaagcgcgcgtangcggccgcctaagcgggacctctaaccttggggctcaacctcaagccgggttccgaactgggtggctcgagtttggnagaggaagatggaattcccggtgtagcggtggaatgcgcagatatcgggaagaacaccgatggcgaaggcagtcttctgggctcataactgacnctgaagcgcgaaagctanngnagcnaacaggattagataccctggtagtcctagccgtaaacgatggncactangtgtggggagatactctttccgtgccgaagcanacgcattaagtgccccgcctggggagtacngccgcaaggctaaa

SEQ ID NO: 783 - DNA, 1510 bp, Ehrlichia chaffeensis
tcaaacttgagagtttgatcctggctcagaacgaacgctggcggcaagcctaacacatgcaagtcgaacggacaattgcttataaccttttggttataaataattgttagtggcagacgggtgagtaatgcgtaggaatctacctagtagtatggaatagccattagaaatgatgggtaatactgtataatccctgcgggggaaagatttatcgctattagatgagcctacgttagattagctagttggtaaggtaatggcttaccaaggctatgatctatagctggtctgagaggacgatcagccacactggaactgagatacggtccagactcctacgggaggcagcagtggggaatattggacaatgggcgaaagcctgatccagctatgccgcgtgagtgaagaaggccttcgggttgtaaaactctttcaatagggaagataatgacggtacctatagaagaagtcccggcaaactctgtgccagcagccgcggtaatacggagggggcaagcgttgttcggaattattgggcgtaaagggcacgtaggtggactagtaagttaaaagtgaaataccaaggcttaactttggagcggcttttaatactgctagactagaggtcgaaagaggatagcggaattcctagtgtagaggtgaaattcgtagatattaggaggaacaccagtggcgaaagcggctatctggttcgatactgacactgaggtgcgaaagcgtggggagcaaacaggattagataccctggtagtccacgctgtaaacgatgagtgctaaatgtgaggattttatctttgtattgtagctaacgcgttaagcactccgcctggggactacggtcgcaagactaaaactcaaaggaattgacggggacccgcacaagcggtggagcatgtggtttaattcgatgcaacgcgaaaaaccttaccactttttgacatgaaggtcgtatccctcctaatagggggagtcagttcggctggaccttacacaggtgctgcatggctgtcgtcagctcgtgtcgtgagatgttgggttaagtcccgcaacgagcgcaaccctcatccttagttaccaacaggtaatgctgggcactctaaggaaactgccagtgataaactggaggaaggtggggatgatgtcaagtcagcacggcccttataaggtgggctacacacgtgctacaatggcaactacaataggtcgcgagaccgcaaggtttagctaatccataaaagttgtctcagttcggattgttctctgcaactcgagagcatgaagtcggaatcgctagtaatcgtggatcatcatgccacggtgaatacgttctcgggtcttgtacacactgcccgtcacgccatgggaattggcttaactcgaagctggtgtgctaaccgcaaggaagcagccatttaaggttgggttagtgactagggtgaagtcgtaacaaggtagctgtaggtgaacctgcggctggattacctccttt

SEQ ID NO: 784 - DNA, 1546 bp, Eikenella corrodens
ttgaacataagagtttgatcctggctcagattgaacgctggcggcatgctttacacatgcaagtcgaacggcagcggggtagtgcttgcactactgtccggcgagtggcgaacgggtgagtaatatatcggaacgtaccgagtaatgggggataaccaatcgaaagattggctaataccgcatacgtcctacgggagaaagcgggggatcgcaagacctcgcgttattcgagcggccgataactgattagctagttggtggggtaaaggcctaccaaggcgacgatcagtagcgggtctgagaggacgatccgccacactgggactgagacacggcccagactcctacgggaggcagcagtggggaattttggacaatgggggcaaccctgatccagccatgccgcgtgtatgaagaaggccttcgggttgtaaagtacttttgttagggaagaaaagggaagtgctaataccactttttgctgacggtacctaaagaataagcaccggctaactacgtgccagcagccgcggtaatacgtagggtgcgagcgttaatcggaattactgggcgtaaagcgagcgcagacggttatttaagcaggatgtgaaatccccgggcttaacctgggaactgcgttctgaactggatagctagagtgtgtcagaggggggtagaattccacgtgtagcagtgaaatgcgtagagatgtggaggaataccgatggcgaaggcagccccctgggataacactgacgttcatgctcgaaagcgtgggtagcaaacaggattagataccctggtagtccacgccctaaacgatgtcgattagctgttgggcaacttgattgcttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccttccagagacggaagggtgccttcgggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaaaccggaggaaggtggggatgacgtcaagtcctcatggcccttatgaccagggcttcacacgtcatacaatggtcggtacagagggtagccaagccgcgaggtggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagcaggtagggtaaccgcaaggagcccgcttgccacggtatgcttcatgactggggtgaagtcgtaacaaggtagccgtaggggaacctgcggctggatcacctcctttct

SEQ ID NO: 785 - DNA, 1533 bp, Enhydrobacter aerosaccus
taaactgaagagtttgatcatggctcagattgaacgctggcggcaggcttaacacatgcaagtcgaacgatgattatctagcttgctagatatgattagtggcggacgggtgagtaacatttaggaatctgcctagtagtgggggatagctcggggaaactcgaattaataccgcatacgacctacgggtgaaagggggcgcaagctcttgctattagatgagcctaaatcagattagctagttggtggggtaaaggcccaccaaggcgacgatctgtaactggtctgagaggatgatcagtcacaccggaactgagacacggtccggactcctacgggaggcagcagtggggaatattggacaatgggggcaaccctgatccagccatgccgcgtgtgtgaagaaggccttttggttgtaaagcactttaagcagggaggagaggctaatggttaatacccattagattagacgttacctgcagaataagcaccggctaactctgtgccagcagccgcggtaatacagagggtgcgagcgttaatcggaattactgggcgtaaagcgagtgtaggtggctcattaagtcacatgtgaaatccccgggcttaacctgggaactgcatgtgatactggtggtgctagaatatgtgagagggaagtagaattccaggtgtagcggtgaaatgcgtagagatctggaggaataccgatggcgaaggcagcttcctggcataatattgacactgagattcgaaagcgtgggtagcaaacaggattagataccctggtagtccacgccgtaaacgatgtctactagccgttggggtccttgagactttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatcctgcagagatgcgggagtgccttcgggaattcacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtaggtacagagggttgctacacagcgatgtgatgctaatctcaaaaagcctatcgtagtccggattggagtctgcaactcgactccatgaagtcggaatcgctagtaatcgcagatcagaatgctgcggtgaatacgttcccgggccttgtacacaccgcccgtcacaccatgggagtctattgcaccagaagtaggtagcctaacgcaagagggcgcttaccacggtgtggtcgatgactggggtgaagtcgtaacaaggtagccgtaggggaacctgcggctggatcacctcctta

SEQ ID NO: 786 - DNA, 1396 bp, Enterobacter aerogenes
  modified_base (9)..(9): a, c, t, g, unknown or other
  modified_base (13)..(13): a, c, t, g, unknown or other
gcggtaacncaanaagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttggcgattgacgttactcgcagaagaagcaccggctaactccgtgccagcagccgcggtaatacgggggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgc

SEQ ID NO: 787 - DNA, 597 bp, Enterobacter asburiae
cagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaatgaattgacgggggccc

SEQ ID NO: 788 - DNA, 1495 bp, Enterobacter cancerogenus
attgaacgctggcggcaggcctaacacatgcaagtcgarcggtarcacagagagcttgctctcgggtgacgagyggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaascctgatgcagccatgccgcgtgtatgaagaaggccttcgggttgtaaagtactttcagcggggaggaaggcgataaggttaataaccttgtcgattgacgttacccgcagaaraagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtcmggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaacctycgggagggcgcttaccactttgtgattcatgactggggtgaagtcgtaacaaggtaaccgtaggggaacctgc

SEQ ID NO: 789 - DNA, 1395 bp, Enterobacter cloacae
tcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaggttaataaccttgttcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagaaatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagg

SEQ ID NO: 790 - DNA, 1362 bp, Enterobacter cowanii
  modified_base (982)..(983): a, c, t, g, unknown or other
ggcggcaggcctaacacatgcaagtcgaacggtaacaggaagcagcttgctgcttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggannggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagcaygcggacctcataaagtgcgtcgtagtccggattggagtctgcaactcgactccatgaagtcggaatcgctagtaatcgtgaatcagaatgtcacggtgaatacgttcccgggccttgtacacaccg

SEQ ID NO: 791 - DNA, 943 bp, Enterobacter hormaechei
gtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggag

SEQ ID NO: 792 - DNA, 1390 bp, Enterobacter sp.
  247BMC
gcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtccattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgatacagtgtgaaatcgccgggctccagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgct

SEQ ID NO: 793 - DNA, 1532 bp, Enterobacter sp.
  638
agagtttgatcatggctcagattgaacgctggcggcaggcctaacacatgcaagtcgagcggtagcacagggagcttgctcctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcacaaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 794 - DNA, 943 bp, Enterobacter sp.
  JC163
  modified_base (88)..(88): a, c, t, g, unknown or other
  modified_base (126)..(126): a, c, t, g, unknown or other
  modified_base (129)..(129): a, c, t, g, unknown or other
  modified_base (148)..(148): a, c, t, g, unknown or other
  modified_base (233)..(233): a, c, t, g, unknown or other
  modified_base (475)..(476): a, c, t, g, unknown or other
  modified_base (489)..(490): a, c, t, g, unknown or other
  modified_base (494)..(494): a, c, t, g, unknown or other
  modified_base (497)..(498): a, c, t, g, unknown or other
  modified_base (507)..(508): a, c, t, g, unknown or other
  modified_base (511)..(511): a, c, t, g, unknown or other
  modified_base (527)..(527): a, c, t, g, unknown or other
  modified_base (624)..(624): a, c, t, g, unknown or other
  modified_base (628)..(628): a, c, t, g, unknown or other
  modified_base (781)..(781): a, c, t, g, unknown or other
  modified_base (927)..(927): a, c, t, g, unknown or other
ccgtgccagcagccgcggtaatacggagggtgcaagcgttaatcggaattactgggcgtaaagcgcacgcaggcggtctgtcaagtcngatgtgaaatccccgggctcaacctgggaactgcattnganactggcaggctggagtctngtagaggggggtagaattccaggtgtagcggtgaaatgcgtagagatctggaggaataccggtggcgaaggcggccccctggacnaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctnntcttgacatccanngaanttnncagagatgnnttngtgccttcgggaactntgagacaggtgctgcatggctgtcgtcagctcgtgttgtgaaatgttgggttaagtcccgcaacgagcgcaacccttatcctttgttgccagcgrtncggncgggaactcaaaggagactgccagtgataaactggaggaaggtggggatgacgtcaagtcatcatggcccttacgasyagggctacacacgtgctacaatggcryatacaaagagaagcgacctcgcgagagcaagcggacctcataaagtrngtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagntagcttaaccttcggg

SEQ ID NO: 795 - DNA, 920 bp, Enterobacter sp.
  SCSS
  modified_base (59)..(60): a, c, t, g, unknown or other
  modified_base (100)..(102): a, c, t, g, unknown or other
  modified_base (107)..(110): a, c, t, g, unknown or other
  modified_base (124)..(124): a, c, t, g, unknown or other
  modified_base (153)..(153): a, c, t, g, unknown or other
  modified_base (179)..(179): a, c, t, g, unknown or other
  modified_base (216)..(216): a, c, t, g, unknown or other
  modified_base (282)..(282): a, c, t, g, unknown or other
  modified_base (295)..(295): a, c, t, g, unknown or other
  modified_base (300)..(300): a, c, t, g, unknown or other
  modified_base (309)..(309): a, c, t, g, unknown or other
  modified_base (314)..(314): a, c, t, g, unknown or other
  modified_base (319)..(319): a, c, t, g, unknown or other
  modified_base (910)..(911): a, c, t, g, unknown or other
aatacggagggtgcaagcgttaatcggaattactgggcgtaaagcgcacgcaggcggtnngtcaagtcagatgtgaaatccccgggctcaacctgggaannngcatnnnnaactggtcaggctngagtctcgtagaggggggtagaattccangtgtagcggtgaaatgcgtagagatntggaggaataccggtggcgaaggcggccccctggacnaagactgacgctcaggtgcgaaagcgtggggagcaaacaggattagataccctggtagtccacgcngtaaacgatgtcnatttngaggttgtnccctngaggngtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaacttggcagagatgcttgggtgccttcgggaactgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaaccggaggaaggtggggatgacgtcaagtcatcatggcccttacgactagggctacacacgtgctacaatggcgtatacaaagagaagcgacctcgcgagagcaagcggacctcataaagtatgtcgtagtccggattggagtctgcaactcgactccatgaagtcggaatcgctagtaatcgtagatcagaatgccacggtgaatacgttcccgggccttgtacacaccgcccgtcacaccatgggagtgggttgcaaaagaagtagnntagcttaac

SEQ ID NO: 796 - DNA, 1377 bp, Enterobacter sp.
  TSE38
  modified_base (1357)..(1363): a, c, t, g, unknown or other
gcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgactccagagaacttcagaatgattgggccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagnnnnnnncttaaccttcggga

SEQ ID NO: 797 - DNA, 1546 bp, Enterobacteriaceae bacterium 9_2_54FAA
tttaattgaagagtttgatcatggctcagattgaacgctggcggcaggcctaacacatgcaagtcgagcggtagcacaagagagcttgctctctgggtgacgagcggcggacgggtgagtaatgtctgggaaactgcctgatggagggggataactactggaaacggtagctaataccgcatgacgtcttcggaccaaagtgggggaccttcgggcctcacgccatcagatgtgcccagatgggattagctagtaggtggggtaatggctcacctaggcgacgatctctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttggtgattgacgttactcgcagaagaagcaccggctaactccgtgccagcagccgcggtaatacggagggtgcaagcgttaatcggaattactgggcgtaaagcgcacgcaggcggttgattaagtcagatgtgaaatccccgagcttaacttgggaactgcatttgaaactggtcagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgctagagatagcttagtgccttcgggaactctgagacaggtgctgcatggctgtcgtcagctcgtgttgtgaaatgttgggttaagtcccgcaacgagcgcaacccttatcctttgttgccagcgaataatgtcgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 798 - DNA, 1314 bp, Enterobacteriaceae bacterium CF01Ent-1
tggctcagattgaacgctggcggcaggcctaacacatgcaagtcgagcgagcggcggacgggtgagtaatgtctgggaaactgcccgatggagggggataactactggaaacggtagctaataccgcataaccaaagttgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggatgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaactgacgctcaggtgcgaaagcgtggggagcaaacaggattagataccctggtagtccacgccgtaaacgatgtcgacttggaggttgtgcgtggcttccggagctaacgcgttaagtcgaccgcctggggagtacggycgcaaggttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcggccgggaactcaaaggagactgccagtgataaactggaggaaggtggggatgacgtcaagtcatcatggcccttacgagtagggctacacacgtgctacaatggcgcacaaagagaagcgacctcgcgagagcaagcggacctcattgcgtcgtagtccggatggagtctgcaactcgactccagaagtcggaatcgctagtaatcgtagatcagaatgctacggtgaatacgttcccgggccttgtacacaccgcccgtcacaccatgggagtgggttgcaaaagaagtaggtgcttagggcgcttaccactttgtgattcatgactggggtgaagtcgtaac

SEQ ID NO: 799 - DNA, 1485 bp, Enterobacteriaceae bacterium Smarlab 3302238
tagagtttgatcctggctcagattgaacgctggcggcaggcctaacacatgcaagtcgaacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtg

SEQ ID NO: 800 - DNA, 1403 bp, Enterococcus avium
tttctttcaccggagcttgctccaccgaaagaaaaggagtggcgaacgggtgagtaacacgtgggtaacctgcccatcagaaggggataacacttggaaacaggtgctaataccgtataacaatcgaaaccgcatggtttcggtttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgcaagtctgaccgagcaacgccgcgtgagtgaagaaggttttcggatcgtaaaactctgttgttagagaagaacaaggatgagagtagaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaggttgaaactcaaaggaattgacgggggcccgcacaagcggtggacatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagcc

SEQ ID NO: 801 - DNA, 1483 bp, Enterococcus caccae
gacgaacgctggcggcgtgcctaatacatgcaagtcgaacgcttcttttctaccgagtgcttgcactcatttgaaaagaggagtggcggacgggtgagtaacacgtgggtaacctacccatcagagggggataacacttggaaacaggtgctaataccgcataatagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactcgagagatcgagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtg

SEQ ID NO: 802 - DNA, 1559 bp, Enterococcus casseliflavus
tatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaaaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttct

SEQ ID NO: 803 - DNA, 1397 bp, Enterococcus durans
tcgtacgcttctttttccaccggagcttgctccaccggaaaaagaagagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgagctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggatcatgtggtttaattcgaagcaacgcgaagaaacttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtg

SEQ ID NO: 804 - DNA, 1421 bp, Enterococcus faecalis
  modified_base (1411)..(1411): a, c, t, g, unknown or other
gtcgaacgcttctttcctcccgagtgcttgcactcaattggaaagaggagtggcggacgggtgagtaacacgtgggtaacctacccatcagagggggataacacttggaaacaggtgctaataccgcataacagtttatgccgcatggcataagagtgaaaggcgctttcgggtgtcgctgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggacgttagtaactgaacgtcccctgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgagctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggcttcagtcgcagtaatacgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgctagaccgcgaggtcatgcaaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaaccttttnggagccagcc

SEQ ID NO: 805 - DNA, 1422 bp, Enterococcus faecium
  modified_base (1411)..(1411): a, c, t, g, unknown or other
tcgtacgcttctttttccaccggagcttgctccaccggaaaaagaggagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaaccttttnggagccagccg

SEQ ID NO: 806 - DNA, 1254 bp, Enterococcus gallinarum
agtggcgaacgggtgagtaacacgtgggtaacctgcccatcagaaggggataacacttggaaacaggtgctaataccgtataacgaaagtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagatgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgactgacgctgaggctcgaaagcgtggggagcgaacaggattagataccctggtagtccacgccgtaaacgatgagtgctaagtgttggagcttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccttattgttagttgccatcatgggcactctagcgagactgccggtgacaaaccggaggaaggtggggatgacgtcaaatcatcatgccccttatgacctgggctacacacgtgctacaatgggaagcaacgagttgcgaagtcgcgaggctaagctaatctcttcttctctcagttcggatgtaggctgcaactcgcctacagaagccggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtg

SEQ ID NO: 807 - DNA, 1295 bp, Enterococcus gilvus
acgctttttctttcaccggagcttgctccaccgaaagaaaaggagtggcgaacgggtgagtaacacgtgggtaacctgcccatcagaaggggataacacttggaaacaggtgctaataccgtataacaatagaaaccgcatggtttctatttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaaaatgttcatcccttgacggtatctgaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcg

SEQ ID NO: 808 - DNA, 1295 bp, Enterococcus hawaiiensis
gacgaacgctggcggcgtgcctaatacatgcaagtcgaacgagtggcgaacgggtgagtaacacgtgggtaacctgcccatcagaaggggataacacttggaaacaggtgctaataccgtataatgaaagtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagatgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgactgacgctgaggctcgaaagcgtggggagcaaacaggattagataccctggtagtccacgccgtaaacgatgagtgctaagtgttggagcttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccttattgttagttgccatcatgggcactctagcgagactgccggtgacaaaccggaggaaggtggggatgacgtcaaatcatcatgccccttatgacctgggctacacacgtgctacaatgggaagcaacgagtcgcgaagtcgcgaggctaagctaatctcttcttctctcagttcggatgtaggctgcaactcgcctacagaagccggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtg

SEQ ID NO: 809 - DNA, 1395 bp, Enterococcus hirae
  modified_base (950)..(950): a, c, t, g, unknown or other
gtcgaacgcttctttttccaccggagcttgctccaccggaaaaagaggagtggcgaacgggtgagtaacacgtgggtaacctgcccatcagaaggggataacacttggaaacaggtgctaataccgtataacaatcaaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggggcacttcggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaggttgaaactcaaaggaattgacgggggcccgcacaagcggtggaccatgtggtttaattcgaagcaacgcgaagatagttgccaggcgttgtccgcnttttactggtctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggt

SEQ ID NO: 810 - DNA, 1559 bp, Enterococcus italicus
ttttatgagagtttgatcctggctcaggacgaacgctggcggcgtgcctaatacatgcaagttgaacgcttctttcttatcgaacttcggttcaccaagaaagaagagtagcgaacgggtgagtaacacgtgggtaacctgcccatcagcgggggataacacttggaaacaggtgctaataccgcataatactttttctctcatgagtgaaagttgaaaggcgcttttgcgtcactgatggatggacccgcggtgcattagctagttggtagggtaacggcctaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagaagagaatgttcatcccttgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttct

SEQ ID NO: 811 - DNA, 1529 bp, Enterococcus mundtii
acgaacgctggcggcgtgcctaatacatgcaagtcgaacgcttcttttcccaccggagcttgctccaccgggaaaagaggagtggcgaacgggtgagtaacacgtgggtaacctgcccatcagaaggggataacacttggaaacaggtgctaataccgtataacaatcgaaaccgcatggtttcgttttgaaaggcgctttacggtgccgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaagggtgagagtaactgttcaccccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcaagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctc

SEQ ID NO: 812 - DNA, 1396 bp, Enterococcus raffinosus
  modified_base (8)..(8): a, c, t, g, unknown or other
  modified_base (13)..(13): a, c, t, g, unknown or other
cgaacgcnttttntttcaccggagcttgctccaccgaaagaaaaggagtggcgaacgggtgagtaacacgtgggtaacctgcccatcagaaggggataacacttggaaacaggtgctaataccgtataacaatagaaaccgcatggtttctatttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtagaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggcggtaatacgtgggtggcaagcgttaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtg

SEQ ID NO: 813 - DNA, 876 bp, Enterococcus sp.
  BV2CASA2
  modified_base (34)..(34): a, c, t, g, unknown or other
  modified_base (41)..(41): a, c, t, g, unknown or other
  modified_base (47)..(47): a, c, t, g, unknown or other
  modified_base (247)..(247): a, c, t, g, unknown or other
  modified_base (850)..(850): a, c, t, g, unknown or other
  modified_base (853)..(853): a, c, t, g, unknown or other
atttattgggcgtaaagcgagcgcaggcggtttnttaagtntgatgngaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtncacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgctagaccgcgaggtcatgcaaatctcttaaagcttctctcagttcggattgcaggctgcaactcgcctgcatgaagccggaatcgctagtaatcgcggatcagcacgccgcggtgaatacgttcccgggccttgtacacaccgcccgtcncancacgagagtttgtaacacccgaa

SEQ ID NO: 814 - DNA, 1262 bp, Enterococcus sp.
  CCRI-16620
gaaaagaggagtggcggacgggtgagtaacacgtgggtaacctacccatcagagggggataacacttggaaacaggtgctaataccgcataatagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactcgagagatcgagctttcccttcggggacaaagtgacaggtggtgcatggttgtcgtcagctcgtgtcgtgagatgttgggttaagtcccgcaacgagcgcaacycctattgttagttgccatcatttagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcg

SEQ ID NO: 815 - DNA, 1522 bp, Enterococcus sp.
  F95
agggtttgatcctggctcaggacgaacgctggcggcgtgcctaatacatgcaagtcgaacgcttctttcctcccgagtgcttgcactcaattggaaagaggagtggcggacgggtgagtaacacgtgggtaacctacccatcagagggggataacacttggaaacaggtgctaataccgcataacagtttatgccgcatggcataagagtgaaaggcgctttcgggtgtcgctgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggacgttagtaactgaacgtcccctgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgctataccgcgaggtcatgcaaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagcc

SEQ ID NO: 816 - DNA, 1406 bp, Enterococcus sp.
  RfL6
tcacttgaaaagaagagtggcggacggggtgagtaacacgtgggtaacctgccccatcagagggggataagacttggaaacaggtgctaataccgcataatagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggccagactcctacgggaggcagcagtagggaatcttcggcaatggacgaagtctgaccgagcaacgccgcgtgagtgaagaaggttttcggatcgtaaaactctgttgttagagaagaacaagtgggagagtaactgctcccgccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagttgaattccatgtgtagcgtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattkacgggggcccgcacaagcggtggagcatgtggtttaattcgaagcaacgcggagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaaccttttggagccagccgcctaaggtgggatagatg

SEQ ID NO: 817 - DNA, 1295 bp, Enterococcus thailandicus
gacgaacgctggcggcgtgcctaatacatgcaagtcgtacgagtggcgaacgggtgagtaacacgtgggtaacctgcccatcagaaggggataacacttggaaacaggtgctaataccgtataacgaaagtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagatgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgactgacgctgaggctcgaaagcgtggggagcaaacaggattagataccctggtagtccacgccgtaaacgatgagtgctaagtgttggagcttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccttattgttagttgccatcatgggcactctagcaagactgccggtgacaaaccggaggaaggtggggatgacgtcaaatcatcatgccccttatgacctgggctacacacgtgctacaatgggaagcaacgagtcgcgaagtcgcgaggctaagctaatctcttcttctctcagttcggatgtaggctgcaactcgcctacagaagccggaatcgctagtaatcgcggatcagcacgccgcggtgaatacgttcccgggccttgtacacaccgcccgtcacaccacgaaagtttgtaacacccgaagtcggtaggtagccagccgcctaaggtgggatagatgattggggtg

SEQ ID NO: 818 - DNA, 1543 bp, Eremococcus coleocola
atgagagtttgatcctggctcaggacgaacgctggcggcgtgcctaatacatgcaagtcgaacgcactgacggagaacttgttctcttaacgtgagtggcggacgggtgagtaacacgtgggaaacctacccttgagcgggggataacggtcggaaacgatcgctaataccgcataacagcaatcatcgcctgatggttgattgaaagatggctctgctatcactcaaggatgggcccgcggtgcattagctagttggtaaggtaacggcttaccaaggccatgatgcatagccgacctgagagggtaatcggccacattgggactgagacacggcccaaactcctacgggaggcagcagtagggaatcttccgcaatggacgcaagtctgacggagcaacgccgcgtgtgtgaagaaggttttcggatcgtaaagcactgttattagccaagaacacccctagtagtaactggctagggattgacggtaactaatcagaaagccacggctaactacgtgccagcagccgcggtaatacgtaggtggcaagcgttgtccggatttattgggcgtaaagggagcgcaggcggtgacttaagtctgatgtgaaagcccacggcttaaccgtggagggtcattggaaactgggtcacttgagtacagaagaggaaagcggaattccatgtgtagcggtgaaatgcgtagatatatggaggaacaccagtggcgaaggcggctttctggtctgatactgacgctgaggctcgaaagcgtggggagcaaacaggattagataccctggtagtccacgccgtaaacgatgagtgctaagtgttggagggtttccacccttcagtgctggcgttaacgcaataagcactccgcctggggagtacggtcgcaagactgaaactcaaaggaattgacggggacccgcacaagcggtggagcatgtggtttaattcgaagcaacgcgaagaaccttaccaggtcttgacatcctatgaccactctagagatagagtttctcttcggagcatagagacaggtggtgcatggttgtcgtcagctcgtgtcgtgagatgttgggttaagtcccgcaacgagcgcaacccttataactagttgccagcattcagatggggactctagttagactgccggtgacaaaccggaggaaggtggggatgacgtcaaatcatcatgccccttatgacctgggctacacacgtgctacaatggacgatacaacgagcagcaaactcgcgagggcaagcgaatctcttaaagtcgttctcagttcggattgcaggctgcaactcgcctgcatgaagccggaatcgctagtaatcgtggatcagcacgccacggtgaatccgttcccgggtcttgtacacaccgcccgtcacaccacgagagtttgtaacacccgaagccggtggcctaacctatgagggagccgtcgaaggtgggatagatgattggggtgaagtcgtaacaaggtagccgtatcggaaggtgcggctggatcacctcctttct

SEQ ID NO: 819 - DNA, 1504 bp, Erysipelothrix inopinata
ggctcaggatgaacgctggcggcgtgcctaatacatgcaagtcgaacgaagttcgaaactagcttgctagattcgaaacttagtggcgaacgggtgagtaatacataagcaacctgcctctatgcctgggataacagatggaaacgtctgctaataccggatacgttaatcgaagacatcttcgattaattaaagttgggatacaacacaaagagatgggcttatggcgcattagttagttggtgaggtaacggctcaccaagacgatgatgcgtagccgacctgagagggtgaccggccacactgggactgagacacggcccagactcctacgggaggcagcagtagggaattttcggcaatgggggaaaccctgaccgagcaacgccgcgtgagtgaagaaggccttcgggttgtaaagctctgttgtaagggaagaacaagtatgagagggaatgctcgtactatgacggtaccttaccagaaagccacggctaactacgtgccagcagccgcggtaatacgtaggtggcgagcgttatccggaattattgggcgtaaagggagcgcaggcggtttattaagtttatggtgaaagttcggggcttaaccccgtgatgccatagaaactggtagactagagtgcaggagaggttagtggaattccatgtgtagcggtaaaatgcgtagatatatggaggaacaccagtggcgaaggcggctaactggcctgtaactgacgctgaggctcgaaagcgtggggagcaaataggattagataccctagtagtccacgccgtaaacgatggatactaagtgttggatagaattcagtgctgtagttaacgcaataagtatcccgcctggggagtatgcgcgcaagcgtaaaactcaaaggaattgacgggggcccgcacaagcggtggagtatgtggtttaattcgaagcaacgcgaagaaccttaccaggtcttgacataccgcgcaaaagcatagagatatgtaatagttatggcggatacaggtggtgcatggttgtcgtcagctcgtgtcgtgagatgttgggttaagtcccgcaacgagcgcaacccttgtcttcagttaccatcattaagttggggactctggagagactgccggtgataaaccggaggaaggtggggatgacgtcaaatcatcatgccccttatgatctgggctacacacgtactacaatggcgtatacagagggaagcgaagcagtgatgtggagcgaatctcagaaagtacgtctcagttcggattggagtctgcaactcgactccatgaagtcggaatcgctagtaatcgcggatcagcatgccgcggtgaatacgttctcgggccttgtacacaccgcccgtcaaaccatgagagttggtaatacccgaagccggtggcctaaccctgtaaagggagggagccgtcgaaggtaggaccgatgattggggttaagtcgtaacaaggtatccctaccggaaggtggg

SEQ ID NO: 820 - DNA, 1545 bp, Erysipelothrix rhusiopathiae
aaatggagagtttgatcctggctcaggatgaacgctggcggcgtgcctaatacatgcaagtcgaacgaagtgaagaggagcttgctccttggaacttagtggcgaacgggtgagtaatacataagcaacctgcctcgatgcctgggataacagagggaaacttctgctaataccggatacgttaatctaagacatcttagattaattaaagatgggatacatcacaacgagatgggcttatggcgcattagttagttggtaaggtaacggcttaccaagacgatgatgcgtagccgacctgagagggtgaccggccacactgggactgagacacggcccagactcctacgggaggcagcagtagggaattttcggcaatgggggaaaccctgaccgagcaacgccgcgtgagtgaagacggccttcgggttgtaaagctctgttgtaagggaagaacgataggaagagggaatgcttcttatatgacggtaccttaccagaaagccacggctaactacgtgccagcagccgcggtaatacgtaggtggcaagcgttatccggaattattgggcgtaaagggagcgcaggcggtttatcaagtttatggttaaagttcggggcttaaccccgtgatgccatagaaactggtagactagagtgcaggagaggttagtggaattccatgtgtagcggtaaaatgcgtagatatatggaggaacaccagtggcgaaggcggctaactggcctgtaactgacgctgaggctcgaaagcgtggggagcaaataggattagataccctagtagtccacgccgtaaacgatggatactaagtgttggagaaattcagtgctgtagttaacgcaataagtatcccgcctggggagtatgcgcgcaagcgtaaaactcaaaggaattgacgggggcccgcacaagcggtggagtatgtggtttaattcgaagcaacgcgaagaaccttaccaggtcttgacataccgcgcaaaagcacagagatgtgtaatagttatggcggatacaggtggtgcatggttgtcgtcagctcgtgtcgtgagatgttgggttaagtcccgcaacgagcgcaacccttgtctttagttaccagcattaagttggggactctaaagagactgccggtgataaaccggaggaaggtggggatgacgtcaaatcatcatgccccttatgatctgggctacacacgtactacaatggcgtatacagagggcagcgaagcagcgatgcggagcgaatctcagaaagtacgtctcagttcggattggagtctgcaactcgactccatgaagtcggaatcgctagtaatcgcggatcagaatgccgcggtgaatacgttctcgggccttgtacacaccgcccgtcaaaccatgagagttggtaatacccgaagccggtggcctaacctagtttactaggagggagccgtcgaaggtaggatcgatgattggggttaagtcgtaacaaggtatccctaccggaaggtggggatggatcacctcctttctaagga

SEQ ID NO: 821 - DNA, 1479 bp, Erysipelothrix tonsillarum
agagtttgatcctggctcaggatgaacgctggcggcgtgcctaatacatgcaagtcgaacgaagtgaagaggagcttgctccttggaacttagtggcgaacgggtgagtaatacataagcaacctgcctcgatgcctgggataacagagggaaacttctgctaataccggatacgttaatctaagacatcttagattaattaaagatgggatacatcacaacgagatgggcttatggcgcattagttagttggtaaggtaacggcttaccaagacgatgatgcgtagccgacctgagagggtgaccggccacactgggactgagacacggcccagactcctacgggaggcagcagtagggaattttcggcaatgggggaaaccctgaccgagcaacgccgcgtgagtgaagacggccttagggttgtaaagctctgttgtaagggaagaacaataagaagagggaatgcttcttatatgacggtaccttaccagaaagccacggctaactacgtgccagcagccgcggtaatacgtaggtggcaagcgttatccggaattattgggcgtaaagggagcgcaggcggtttatcaagtttatggttaaagttcggggcttaaccccgtgatgccatagaaactggtagactagagtgcaggagaggttagtggaattccatgtgtagcggtaaaatgcgtagatatatggaggaacaccagtggcgaaggcggctaactggcctgtaactgacgctgaggctcgaaagcgtggggagcaaataggattagataccctagtagtccacgccgtaaacgatggatactaagtgttggagaaattcagtgctgtagttaacgcaataagtatcccgcctggggagtatgcgcgcaagcgtaaaactcaaaggaattgacgggggcccgcacaagcggtggagtatgtggtttaattcgaagcaacgcgaagaaccttaccaggtcttgacataccgcgcaaaagcacagagatgtgtaatagttatggcggatacaggtggtgcatggttgtcgtcagctcgtgtcgtgagatgttgggttaagtcccgcaacgagcgcaacccttgtctttagttaccagcattaagttggggactctaaagagactgccggtgataaaccggaggaaggtggggatgacgtcaaatcatcatgccccttatgatctgggctacacacgtactacaatggcgtatacagagggcagcgaagcagcgatgcggagcgaatctcagaaagtacgtctcagttcggattggagtctgcaactcgactccatgaagtcggaatcgctagtaatcgcggatcagaatgccgcggtgaatacgttctcgggccttgtacacaccgcccgtcaaaccatgagagttggtaatacccgaagccggtggcctaacctagtttactaggagggagccgtcgaaggtaggatcgatgattgggg

SEQ ID NO: 822 - DNA, 1387 bp, Erysipelotrichaceae bacterium 3_1_53
  modified_base (935)..(936): a, c, t, g, unknown or other
  modified_base (1381)..(1381): a, c, t, g, unknown or other
tctctaggaagcttgcttccaaagagacttagtggcgaacgggtgagtaacacgtaggtaacctgcccatgtgtctgggataactgctggaaacggtagctaaaaccggataggtatacggagcgcatgctctgtatattaaagcacccttcaaggtgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatggggggaaccctgaacgagcaatgccgcgtgagtgaagaaggtcttcggatcgtaaagctctgttgtaagtgaagaacggctcataggaaatgctatgggagtgaggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggtcaaccattgtaagctatggaaactggtaggctagagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaannccctagagatagggagataaatatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaagaagcgaatctcataaaggccgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagngagccg

SEQ ID NO: 823 - DNA, 1357 bp, Erysipelotrichaceae bacterium 5_2_54FAA
  modified_base (14)..(14): a, c, t, g, unknown or other
  modified_base (1311)..(1312): a, c, t, g, unknown or other
tccaaagagacttngtggggaacgggtgagtaacacgtaggtaacctgcccatgtgcccgggataactgctggaaacggtagctaaaaccggataggtatgagggaggcatcttcctcatattaaagcaccttcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtgaagaaggtcttcggatcgtaaagcactgttgtaagtgaagaatgccatatagaggaaatgctatgtgggtgacggagcttaccagaaagccacggtaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatgtatataaatgatctagaaatagaaagatagctatatatcacacaggtggtgcatggttgtcgtcagctcgtgtcgtgagatgttgggttaagtcccgcaacgagcgcaacccttgtcttctgttaccagcattaagttggggactcaggagagactgccggtgacaaaccggaggaaggtggggatgacgtcaaatcatcatgccccttatggcctgggctacacacgtactacaatggcgcctacaaagagcagcgacaccgcgaggtggagcgaatctcataaagggcgtctcagttcggattgaagtctgcaactcgacttcatgaagtcggaatcgctagtaatcgcagatcagcatgctgcggtgaatacgttctcgggccttgtacacaccgcccnncaaaccatgggagttggtaatacccgaagccggtggcataaccgc

SEQ ID NO: 824 - DNA, 1545 bp, Escherichia albertii
ttaaattgaagagtttgatcatggctcagattgaacgctggcggcaggcctaacacatgcaagtcgaacggtaacaggaaacagcttgctgtttcgctgacgagtggcggacgggtgagtaatgtctgggaaactgcccgatggagggggataactactggaaacggtagctaataccgcataacgtcgcaagaccaaagagggggaccttagggcctcttgccatcggatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggttgattaagtcagatgtgaaatccccgggctcaacctgggaactgcatctgatactggtcagcttgagtctcgtagaggggggtagaattccaggtgtagcggtgaaatgcgtagagatctggaggaataccggtggcgaaggcggccccctggacgaagactgacgctcatgtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 825 - DNA, 1403 bp, Escherichia coli
  modified_base (20)..(20): a, c, t, g, unknown or other
gtcgaacggtaacaggaagncagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcagtgcgaaagcgtggggagcaaacaggattagataccctggtagtccacgccgtaaacgatgtcgacttggaggttgtgcccttgaggcgtggcttcggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcta

SEQ ID NO: 826 - DNA, 1395 bp, Escherichia fergusonii
  modified_base (14)..(16): a, c, t, g, unknown or other
tcgaacggtaacannnagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagcttgtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaaaaaccttacctggtcttgacatccacagaactttccagagatggatgcgtaacgtgcaggaaggcggtttgtgaagtcagatgctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcggga

SEQ ID NO: 827 - DNA, 1517 bp, Escherichia hermannii
ctccagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaac

SEQ ID NO: 828 - DNA, 1542 bp, Escherichia sp.
  1_1_43
aaattgaagagtttgatcatggctcagattgaacgctggcggcaggcctaacacatgcaagtcgaacggtaacaggaaacagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctta

SEQ ID NO: 829 - DNA, 1530 bp, Escherichia sp.
  4_1_40B
agagtttgatcatggctcagattgaacgctggcggcaggcctaacacatgcaagtcgaacggtaacaggaaacagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacct

SEQ ID NO: 830 - DNA, 1334 bp, Escherichia sp.
  B4
gagtttgatcctggctcagattgaacgctggcggcaggcctaacacatgcaagtcgaacgagtggcggacgggtgagtaatgtctgggaaactgcctgatggagggggataactactggaaacggtagctaataccgcataaccaaagttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggatgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaactgacgctcaggtgcgaaagcgtggggagcaaacaggattagataccctggtagtccacgccgtaaacgatgtcgacttggaggttgtgcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatcgacaggtgctgcatggctgtcgtcagctcgtgttgtgaaatgttgggttaagtcccgcaacgagcgcaacccttatcctttgttgccagcggccgggaactcaaaggagactgccagtgataaactggaggaaggtggggatgacgtcaagtcatcatggcccttacgaccagggctacacacgtgctacaatggcgcacaaagagaagcgaactcgcgagagcaagcggacctcattgcgtcgtagtccggatggagtctgcaactcgactccagaagtcggaatcgctagtaatcgtggatcagaatgccacggtgaatacgttcccgggccttgtacacaccgcccgtcacaccatgggagtgggttgcaaaagaagtaggtgcttagggcgcttaccactttgtgattcatgactggggtgaagtcgtaacaaggtaacc

SEQ ID NO: 831 - DNA, 1397 bp, Escherichia vulneris
agtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggacgcacgcaggcggtctgtcaagtcggatgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagg

SEQ ID NO: 832 - DNA, 1497 bp, Ethanoligenens harbinense
agagtttgatcctggctcaggacgaacgctggcggcgcgcctaacacatgcaagtcgagcggagtccttcgggacttagcggcggacgggtgagtaacgcgtgagcaacctggccttcagagggggataacgtctggaaacggacgctaataccgcatgacatggcggagtcgcatggctctgccatcaaaggagtaatccgctgagggatgggctcgcgtccgattaggtagttggtgaggtaacggctcaccaagcccgcgatcggtagccggactgagaggttggccggccacattgggactgagacacggcccagactcctacgggaggcagcagtgggggatattgcacaatggaggaaactctgatgcagcgacgccgcgtgagggaagaaggtcttcggattgtaaacctctgtctttggggacgaatcaatgacggtacccaaggaggaagccacggctaactacgtgccagcagccgcggtaatacgtaggtggcaagcgttgtccggaattactgggtgtaaagggtgcgcaggcggggcggcaagttggatgtgaaaactccgggctcaacccggagcctgcattcaaaactgtcgctcttgagtgaagtagaggcaggcggaattcccggtgtagcggtgaaatgcgtagatatcgggaggaacaccagtggcgaaggcggcctgctgggcttttactgacgctgaggcacgaaagcatgggtagcaaacaggattagataccctggtagtccatgccgtaaacgatgattgctaggtgtggggggtctgaccccttccgtgccggagttaacacaataagcaatccacctggggagtacgggtcgcaaggttgaaactcaaaggaattgacgggggctcgcacaagcagtggagtatgtggtttgattcgaagcaacgcgaagaaccttaccaggtcttgacatccaccgaatcccccagagattggggagtgcccttcggggagcggtgagacaggtggtgcatggttgtcgtcagctcgtgtcgtgagatgttgggttaagtcccgcaacgagcgcaacccttgtgaatagttgctacgaaagagcactctattcagaccgccgttgacaaaacggaggaaggtggggatgacgtcaaatcatcatgccccttatgacctgggctacacacgtactacaatggccatcaacagagggaagcaaggccgcgaggtggagcgaacccctaaaaatggtctcagctcagattgcaggctgaaacccgcctgcatgaagatggaattgctagtaatcgcggatcagcatgccgcggtgaatacgttcccgggccttgtacacaccgcccgtcacaccatgagagccggggacacccgaagtcggttgggtaaccgtaaggagcccgccgccgaaggtggaatcggtaattggggtgaagtcgtaacaaggtagccgtatcggaaggtgcggctggatcacctccta

SEQ ID NO: 833 - DNA, 1318 bp, Eubacteriaceae bacterium P4P_50 P4
gatgaacgctggcggcgtgcctaacacatgcaagtcgaacgagtggcggacgggtgagtaacacgtaagtaatcaacctataacacacgaataactaatagaaatgttagctaatacgagataaacaaaggcggttatagacgagcttgcgtctgattagctagttggtggggtaagagcctaccaaggcgacgatcagtagccgacctgagagggtgaacggccacattggaactgagagacggtccaaactcctacgggaggcagcagtgggggatattgcacaatggggggaaccctgatgcagcaacgccgcgtgaacgaagaaggccctagggtcgtaaagttctgtcgtatgggaagatgacagtaccatacaagaaagccccggctaactacgtgccagcagccgcggtaatacgtagggggcaagcgttatccggaattactgggcgtaaagggtgcgtaggcggcttgttaagtcaaggttaaaaggcagtagctcaactactgttcggccttgaaactattaagcttgagtataggagaggaaagtggaattcccagtgtagcggtgaaatgcgtagatattgggaggaataccggtggcgaaggcgactttctggactaactgacgctgaggcacgaaagtgtgggtagcaaacaggattagataccctggtagtccacaccgtaaacgatgaacactaggtgtcgggatctcggtgccggcgcaaacgcaataagtgttccgcctggggagtacgttcgcaagaataaaactcaaaggaattgacggggacccgcacaagtagcggagcatgtggtttaattcgaagcaacgcgaagaaccttacctaagcttgacatgcacaggtggtgcatggttgtcgtcagctcgtgtcgtgagatgttgggttaagtcccgcaacgagcgcaacccctattaatagttgccagtgcgcaggcactctagtaagacagttagggataacctaaaggaaggtggggatgacgtcaaatcatcatgccccttatgcttagggctacacacgtgctacaatggccgtcaaagagaagcgaatctgtgaagaagagcaaacctgaaacggtccaagttcggatgtaggctgaaactcgcctacagaagtcggagttactagtaatcgcaaatcagaatgttgcggtgaatgcgttcccgggtcttgtacacaccgcccgtcacaccatgggagctgagggcacccaaagtcagtatctaagaagctgcctaaggtgaacttagtaactggggtgaagtcgtaacaaggtagccgta

SEQ ID NO: 834 - DNA, 1527 bp, Eubacterium barkeri
  modified_base (617)..(618): a, c, t, g, unknown or other
  modified_base (1473)..(1473): a, c, t, g, unknown or other
  modified_base (1475)..(1479): a, c, t, g, unknown or other
  modified_base (1488)..(1493): a, c, t, g, unknown or other
  modified_base (1504)..(1512): a, c, t, g, unknown or other
tttaattgagagtttgatcctggctcaggacgaacgctggcggtatgcttaacacatgcaagtcgaacgagaagctttttatggatccttcgggagaaataagagtggaaagtggcgaacgggtgagtaacgcgtgggtaacctgcctcatggaaaggaatagcctcgggaaactgggagtaaagccttatattattaagacatcgcatggtgttttaatgaaaactccggtgccatgagatggacccgcgtcccattagctagttggtgagataacagcccaccaaggcaacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaaactcttttattggggaagaagaagtgacggtacccaatgaagaagtcccggctaactacgtgccagcagccgcggtaatacgtaggggacaagcgttgtccggaatcactgggcgtaaagggcgcgtaggcggttttataagtcagatgtgaaaggtaccggctcaaccggnnacgtgcatttgaaactgtaagacttgagtactggagaggcaagtggaattcctagtgtagcggtgaaatgcgtagatattaggaggaacaccggtggcgaaggcggcttgctggacagatactgacgctgaggtgcgaaagcgtggggagcgaacaggattagataccctggtagtccacgccgtaaacgatgatgactaggtgttggggaaactcagtgccgcagttaacacattaagtcatccgcctggggagtacgaccgcaaggttgaaactcaaaggaattgacggggacccgcacaagcagcggagcatgtggtttaattcgaagcaacgcgaagaaccttaccaggccttgacatcctctgaccatcctagagataggagatttccttcgggaacagagagacaggtggtgcatggttgtcgtcagctcgtgtcgtgagatgttgggttaagtcccgcaacgagcgcaacccttgcctttagttgccagcattaagttgggcactctaaagggactgccgtagacaatacggaggaaggtggggacgacgtcaaatcatcatgccccttatggcctgggctacacacgtgctacaatgggttgggacaaagggaagcgaagccgcgaggtgaagccaatcccataaaacaacccccagttcggattgcaggctgaaacccgcctgcatgaagttggagttgctagtaatcgcagatcagaatgctgcggtgaatgcgttcccgggtcttgtacacaccgcccgtcacaccacgagagttggcaacacccgaagccagtgagcgaaccgcaaggacgcagctgtcgaaggtggggtcagtaattggggngnnnnngtaacaagnnnnnngtatcggaagnnnnnnnnngatcacctcctttct

SEQ ID NO: 835 - DNA, 1538 bp, Eubacterium biforme
tggagagtttgatcctggctcaggatgaacgctggcggcatgcctaatacatgcaagtcgaacgagaggaaggaaagcttgcttttctgaatctagtggcgaacgggtgagtaacacgtaggtaacctgcccatgtgcccgggataacttctggaaacggatgctaaaaccggataggtagcagacaagcatttgactgctattaaagtggctaaggccatgaacatggatggacctgcggtgcattagctagttggtgaggtaacggcccaccaaggcgacgatgcatagccggcctgagagggcggacggccacattgggactgagacacggcccaaactcctacgggaggcagcagtagggaattttcgtcaatggggggaaccctgaacgagcaatgccgcgtgagtgaggaaggtcttcggatcgtaaagctctgttgtaagagaaaaacgacattcatagggaatgatgagtgagtgatggtatcttaccagaaagtcacggctaactacgtgccagcagccgcggtaatacgtaggtggcgagcgttatccggaatgattgggcgtaaagggtgcgtaggtggcagaacaagtctggagtaaaaggtatgggctcaacccgtactggctctggaaactgttcagctagagaacagaagaggacggcggaactccatgtgtagcggtaaaatgcgtagatatatggaagaacaccggtggcgaaggcggccgtctggtctgttgctgacactgaagcacgaaagcgtggggagcaaataggattagataccctagtagtccacgccgtaaacgatgagaactaggtgttgggggaataactcagtgccgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatcccttgcagaggtatagagatatatccgaggttatcaaggagacaggtggtgcatggttgtcgtcagctcgtgtcgtgagatgttgggttaagtcccgcaacgagcgcaacccttgtgatatgttactaacattgagttgaggactcatatcagactgccggtgataaaccggaggaaggtggggatgacgtcaaatcatcatgccccttatggcctgggctacacacgtactacaatggcgtctacaaagagcggcaagcctgtgaaggcaagcgaatctcataaaggacgtctcagttcggattgaagtctgcaacccgacttcatgaagctggaatcgctagtaatcgcgaatcagcatgtcgcggtgaatacgttctcgggccttgtacacaccgcccgtcaaaccatgggagttggtaatgcccgaagccggtggcataacctttcgaggagtgagccgtcgaaggcaggaccgatgactggggttaagtcgtaacaaggtatccctacgggaacgtggggatggatcacctcctttct

SEQ ID NO: 836 - DNA, 1438 bp, Eubacterium brachy
gatgaacgctggcggcgtgcttaacacatgcaagtcgagcgagaagttttgaaaagattcttcggatgaaatttaaaatggaaagcggcggacgggtgagtaacgcgtaggcaaccatacaaagggatagcatttggaaacgaatattaataccttatgaaacttaactagtgcatgctaggtaggtcaaagatttatcggtatgggatgggcctgcgtctgactgcccttagctagttggtgaggtaacggctcaccaaggcgacgatcagtagccgacctgagagggtgaacggccacattggaactgagacacggtccaaactcctacgggaggcagcagtggggaatattgcacaatgggggaaaccctgatgcagcaacgccgcgtgaacgatgaaggcctttgggtcgtaaagttctgttctaggtgatgaaaactgacagtaacctaggagaaagccccggctaactccgtgccagcagccgcggtaatactggagggggcaagcgttatccggaattattgggcgtaaagggtacgtaggtggccttttaagcgtagggtataaggcaatggctcaaccattgttcgccctatgaactggaaggcttgagtgcaggagaggaaagcggaattcctagtgtagcggtggaatgcatagatattaggaggaacatcagcggcgaaggcggctttctggactgcaactgacactgaggtacgaaagcgtggggagcaaacaggattagataccctggtagtccacgccgtaaacgatgagcactaggtgtcggggtcgtaaggcttcggtgccgtagttaacgcattaagtgctccgcctggggagtacgcacgcaagtgtgaaactcaaaggaattgacggggacccgcacaagcagcggagcatgtggtttaattcgaagcaacgcgagaaccttaccaggacttgacatccttctgaccggtctttaataggacctttcttttgacagaagagacaggtggtgcatggttgtcgtcagctcgtgtcgtgagatgttgggttaagtcccgcaacgagcgcaacccttgtcattagttgccatcattaagttgggcactctagtgagactgccggggacaactcggaggaaggtggggatgacgtcaaatcatcatgccccttatgttctgggctacacacgtgctacaatggctggtacaaagagaagcaagaccgcaaggtggagcaaagctcaaaaaccagccccagttcggattgtaggctgaaactcgcctacatgaagtcggagttgctagtaatcgcagatcagaatgctgcggtgaatgcgttcccgggtcttgtacacaccgcccgtcacaccatggaagttgggggcgcccaaagttggcagataaatatgctacctaaggtgaaaccaatgactggggtga

SEQ ID NO: 837 - DNA, 1472 bp, Eubacterium budayi
agagtttgatcctggctcaggacgaacgctggcggcgtgcctaacacatgcaagtcgagcgatgaagtttccttcgggaaacggattagcggcggacgggtgagtaacacgtgggtaacctgcctcatagaggggaatagcctcccgaaagggagattaataccgcataacattgcagtttcgcatgaaacagcaattaaaggagcaatccgctatgagatggacccgcggcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttgggcacgataatgacgtacccaaggaggaagccacggctaactacgtgccagcagccgcggtaatacgtaggtgccgaacgttgtccggatttactggccgtaaagggagcgtaggcggatttttaagtgggatgtgaaatacccgggctcaacctgggtgctgcattccaaactgggaatctagagtgcaggaggggagagtggaattcctagtgtagcggtgaaatgcgtagagattaggaagaacaccagtggcgaaggcgactctctggactgtaactgacgctgaggctcgaaacgtggggagcgaacaggattagataccctggtagtccacgccgtaaacgatgaatactaggtgtaggggtttcaacacctctgtgccgccctaacgcattaagtattccgcctggggagtacggtcgcaagattaaaactcaaaggaattgacgggggcccgcacaagtagcggagcatgtggtttaattcgaagcaacgcgaagaaccttacctagacttgacatcctctgcattacccttaatcggggaagttccttcgggaacagagtgacaggtggtgcatggttgtcgtcagctcgtgtcgtgagatgttgggttaagtcccgcaacgagcgcaacccctattgttagttgctaccattaagttgagcactctagcgagactgcctgggttaaccaggaggaaggtggggatgacgtcaaatcatcatgccccttatgtctagggctacacacgtgctacaatggcaagtacagagagatgcaataccgcgaggtggagctaaacttcaaaacttgtctcagttcggattgtaggctgaaactcgcctacatgaagctggagttactagtaatcgcgaatcagcatgtcgcggtgaatacgttcccgggccttgtacacaccgcccgtcacaccatgagagttggcaatacccaaagttcgtgagctaacgcgtaagcaggcagctacctaaggtagggtcagcgattggggtgaagtcgtaacaaggtaacc

SEQ ID NO: 838 - DNA, 1338 bp, Eubacterium callanderi
cttcgggtgacattagaactggaaagtggcgaacgggtgagtaacgcgtgggtaacctgccctatggaaaggaatagcctcgggaaactgggagtaaagccttatattatggttttgtcgcatggcaagatcatgaaaactccggtgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcaaagctctgttattggggaagaagaatgacggtagagaaccgctaactacgtgccagcagccgcggtaatacgtaggggacaagcgtttccggaatgactgggcgtaaagggcgcgtaggcggtctattaagttgatgtgaaaggtaccggctcaaccggtgaagtgcattggaaactggtaacttgagtattggagaggcaagtggaattcctagtgtacggtgaaatgcgtaatattaggaggaacaccagtggcgaaggcggcttgctggacaaatactgacgctgagtgcgaaagcgtggggagcgaacaggatcagataccctggtagtccacgccgtaaacgatgaatgctaggtgttggggaaactcagtgccgcagttaacacaataagcattccgcctggggagtacgaccgccaggttgaaactcaaaggaattgacggggacccgcacaagcagcggagcatgtggtttaattcgaagcaacgcgaagaagcttaccattggtaactggcagacttgagtcttggagagggaaagtttccttcgggaacagagagacaggtggtgcatggttgtcgtcagctcgtgtcgtgagatgttgggttaagtcccgcaacgagcgcaacccctgcctttagttgccagcattaagttgggcactctagagggactgccgtagacaatacggaggaaggtggggacgacgtcaaatcatcatgccccttatgacctgggctacacacgtgctacaatggtctgaacagagggccgcgaagccgcgaggtgaagcaaatcccttaaaacagatcccagttcggattgcaggctgcaactcgcctgcatgaagttggagttgctagtaatcgcggatcagaatgccgcggtgaatgcgttcccgggtcttgtacacaccgcccgtcacaccacgagagttggcaacacccgaagcctgtgagagaaccgcaaggactcagc

SEQ ID NO: 839 - DNA, 1524 bp, Eubacterium cellulosolvens
  modified_base (1492)..(1492): a, c, t, g, unknown or other
tgagtttgatcctggctcaggatgaacgctggcggcgtgcttaacacatgcaagtcgagctaagcactctggaagattccttcgggatgattccttagtgacttagcggcggacgggtgagtaacgcgtgggcaacctgccttgtacagggggataacagttagaaatgactgctaataccgcataagcgcacagcatggcatcatgcagtgtgaaaaactccggtggtacaagatgggcccgcgttggattagcttgttggtggggtaacggcccaccaaggcgacgatccatagccggactgagaggtcgaacggccacattgggactgagacacggcccagactcctacgggaggcagcagtggggaatattgcacaatggaggaaactctgatgcagcgacgccgcgtgagtgatgaagtatttcggtatgtaaagctctatcagcagggaagaaattgacggtacctgactaagaagccccggctaactacgtgccagcagccgcggtaatacgtagggggcaagcgttatccggatttactgggtgtaaagggagcgtagacggcgatgcaagtctgaagtgaaaacctggggctcaaccccaggattgctttggaaactgtattgctagagtaccggaggggtaagcggaattcctagtgtagcggtgaaatgcgtagatattaggaggaacaccggtggcgaaggcggcttactggacggcaactgacgttgaggctcgaaagcgtggggagcaaacaggattagataccctggtagtccacgccgtaaacgatgaatactaggtgtcagcaggcaaagcctgttggtgccgccgctaacgcattaatgtattccacctggggagtacgttcgcaagaatgaaactcaaaggaattgacggggacccgcacaagcggtggagcatgtggtttaattcgaagcaacgcgaagaaccttaccaaatcttgacatccctctgacagatccttaatcggatccttccttcgggacagaggagacaggtggtgcatggttgtcgtcagctcgtgtcgtgagatgttgggttaagtcccgcaacgagcgcaacccttatccttagtagccagcaggtcaagctgggcactctggggagactgccagggagaacctggaggaaggtggggatgacgtcaaatcatcatgccccttatgatttgggctacacacgtgctacaatggcgtgaacagagggaagcgaagccgcgaggcctggcaaatctcaaaaaacacgtcccagttcggactgtagtctgcaactcgactacacgaagctggaatcgctagtaatcgcagatcagaatgctgcggtgaatacgttcccgggtcttgtacacaccgcccgtcacaccatgggagttggtaatgcccgaagtctgtgacccaaccgcaaggagggagcagccgaaggcagggccagtaactggggtgaagtcgtaacaaggtanccgtatcggaaggtgccggctggatcaccttt

SEQ ID NO: 840 - DNA, 1362 bp, Eubacterium contortum
cggattgaagagttttgcgactgagcggcggacgggtgagtaacgcgtgggtaacctgcctcatacagggggataacagttagaaatgactgctaataccgcataagaccacggtaccgcatggtaccgtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgcatactaggtgtcgggtggcaaagccattcggtgccgcagcaaacgcaataagtatgccacctggggagtacgttcgcaagaatgaaactcaaaggaattgacggggacccgcacaagcggtggagcatgtggtttaattcgaagcaacgcgaagaaccttacctgctcttgacatccccctgaccggcgcgtaatggtgcctttccttcgggacagggctagtggaggggtgaagttcgtagacagctcgtgtcgtgagatgttgggttaagtcccgcaacgagcgcaacccttatctttagtagccagcggttcggccgggcactctagagagactgccagggataacctggaggaaggtggggatgacgtcaaatcatcatgccccttatgagcagggctacacacgtgctacaatggcgtaaacaaagggaggcgaagccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggag

SEQ ID NO: 841 - DNA, 1446 bp, Eubacterium coprostanoligenes
gtgtgcctaacacatacaagtcagtcgacgagcttgacgaacgattcttcggatgaattctgatatgactgagtggcggacgggtgagtaacgcgtgagcaacctgcccttcagagggggatagcgtctggaaacggacggtaataccgcataatgtacaatgatggcatcattgatgtaccaaagctattgcgctgaaggatgggctcgcgtctgattagatagttggtggggtaacggcctaccaagtcgacgatcagtagccggactgagaggttgaacggccacattgggactgagacacggcccagactcctacgggaggcagcagtggggaatattgcacaatgggcgcaagcctgatgcagcaacgccgcgtggaggaagacggttttcggattgtaaactcctgttcttagtgaagaaaaatgacggtagctaaggagcaagccacggctaactacgtgccagcagccgcggtaatacgtaggtggcaagcgttgtccggaattactgggtgtaaagggagcgcaggcgggggagcaagtcagctgtgaaatctatgggcttaacccataaactgcagttgaaactgttcttcttgagtgaagtagaggttggcggaattccgagtgtagcggtgaaatgcgtagatattcggaggaacaccggtggcgaaggcggccaactgggcttttactgacgctgaggctcgaaagtgtggggagcaaacaggattagataccctggtagtccacactgtaaacgatgataactaggtgtagggggtctgaccccttctgtgccgcagctaacgcaataagttatccacctggggagtacgaccgcaaggttgaaactcaaaggaattgacggggacccgcacaagcagtggattatgtggtttaattcgatgcaacgcgaagaaccttaccagcacttgacatccaactaacgaaatagagatatattaggtgcccctcggggaaagttgagacaggtggtgcatggttgtcgtcagctcgtgtcgtgagatgttgggttaagtcccgcaacgagcgcaacccctgccattagttgctacgcaagagcactctaatgggaccgctaccgacaaggtggaggaaggtggggatgacgtcaaatcatcatgccccttatgtgctgggctacacacgtaatacaatggtcgttaacaaagagaagcaataccgcgaggtggagcaaaacttcaaaaacgatctcagttcggactgtaggctgaaactcgcctgcacgaagttggaattgctagtaatcgtggatcagcatgccacggtgaatacgttcccgggtcttgtacacaccgcccgtcacaccatgggagccggtaatacccgaagtcagtagtctaaccttaatggaggacgctgccgaaggtaggattggcgactggggtgaagtcgt

SEQ ID NO: 842 - DNA, 1541 bp, Eubacterium cylindroides
tggagagtttgatcctggctcaggatgaacgctggcggcatgcctaatacatgcaagtcgaacggaccgaagggaaagcttgcttttcctgaagtcagtggcgaacgggtgagtaacacgtaggtaacctgcccatgtgcccgggacaacgcctggaaacgggtgctaaaaccggataggtagagagatcgcatgaactttctattaaaggggctacggccctgaacatggatggacctgcggtgcattagctagttggtgaggtaacggcccaccaaggcgacgatgcatagccgacctgagagggcgaacggccacattgggactgagacacggcccaaactcctacgggaggcagcagtagggaattttcgtcaatggggggaaccctgaacgagcaatgccgcgtgagtgaagacggtcttcggattgtaaagctctgttgcgagagaaaaacgacacggatagggaatgatccgtgggtgatggtatctcgccagaaagtcacggctaactacgtgccagcagccgcggtaatacgtaggtggcgagcgttatccggaatgattgggcgtaaagggtgcgtaggcggcccgttaagtctggagtcaaagccggcagctcaactgtcgtacgctttggaaactggcgggctggagtgcagaagagggcgatggaactccatgtgtagcggtaaaatgcgtagatatatggaagaacaccagtggcgaaggcggtcgcctggtctgcaactgacgctgaagcacgaaagcgtggggagcaaataggattagataccctagtagtccacgccgtaaacgatgagaactaagtgttgggggaataactcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatcccgggcaagggcgtagagatacgccggaggctatcccggtgacaggtggtgcatggttgtcgtcagctcgtgtcgtgagatgttgggttaagtcccgcaacgagcgcaacccttgtgatatgttactaccagtaagatgaggactcatatcagactgccggtgacaaaccggaggaaggtggggatgacgtcaaatcatcatgccccttatggcctgggctacacacgtactacaatggcgcatacaaagagcagcgaacccgtgagggcaggcgaatctcgcaaagtgcgtctcagttcggattgaagtctgcaacccgacttcatgaagttggaatcgctagtaatcgcgaatcagcatgtcgcggtgaatacgttctcgggccttgtacacaccgcccgtcaaaccatgggagttggtaatacccgaagccggtggcataacccattcagggagtgagccgtcgaaggtaggatcgatgactggggttaagtcgtaacaaggtatccctacgggaacgtggggatggatcacctcctttct

SEQ ID NO: 843 - DNA, 1470 bp, Eubacterium desmolans
  modified_base (1)..(1): a, c, t, g, unknown or other
  modified_base (32)..(32): a, c, t, g, unknown or other
  modified_base (275)..(275): a, c, t, g, unknown or other
  modified_base (401)..(401): a, c, t, g, unknown or other
  modified_base (575)..(575): a, c, t, g, unknown or other
  modified_base (580)..(580): a, c, t, g, unknown or other
  modified_base (602)..(602): a, c, t, g, unknown or other
  modified_base (917)..(919): a, c, t, g, unknown or other
  modified_base (957)..(958): a, c, t, g, unknown or other
  modified_base (980)..(980): a, c, t, g, unknown or other
  modified_base (1017)..(1017): a, c, t, g, unknown or other
  modified_base (1026)..(1026): a, c, t, g, unknown or other
  modified_base (1039)..(1039): a, c, t, g, unknown or other
  modified_base (1080)..(1080): a, c, t, g, unknown or other
  modified_base (1180)..(1181): a, c, t, g, unknown or other
  modified_base (1196)..(1196): a, c, t, g, unknown or other
  modified_base (1374)..(1375): a, c, t, g, unknown or other
ntttttagagagtttgatcctggctcaggatnaacgctggcggcgtgcctaacacatgcaagtcgaacggagttattttggaaatctcttcggagatggaattcataacttagtggcggacgggtgagtaacgcgtgagcaatctgcctttaggtgggggataacagtcggaaacggctgctaataccgcataatacgttttgggggcatccttgaaacgtcaaagatttattgcctttagatgagctcgcgtctgattagctggttggcggggnaacggcccaccaaggcgacgatcagtagccggactgagaggttgaacggccacattgggactgagacacggcccagactcctacgggaggcagcagtggggaatattgcgcaatgggggaaacccngacgcagcaacgccgcgtgattgaagaaggccttcgggttgtaaagatctttaatcagggacgaattttgacggtacctgaagaataagctccggctaactacgtgccagcagccgcggtaatacgtagggagcaagcgttatccggatttactgggtgtaaagggcgcgcagncgggncggcaagttgggagtgaaatcngggggcttaacccccgaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgnnngcccgcacaagcagtggagtatgtggtttaattcgaannaacgcgaagaaccttaccaggncttgacatcccggtgaccgtcctagagataggacttnccttcgggncaacggtgacagntggtgcatggttgtcgtcagctcgtgtcgtgagatgttggnttaagtcccgcaacgagcgcaacccttacggttagttgatacgcaagatcactctagccggactgccgttgacaaaacggaggaaggtggggacgacgtnnaatcatcatgccccntatgacctgggctacacacgtactacaatggcagtcatacagagggaagcaaaatcgcgaggtggagcaaatccctaaaagctgtcccagttcagattgcaggctgcaacccgcctgcatgaagtcggaattgctagtaatcgcggatcagcatgccgcggtgaatacgttcccgggnnttgtacacaccgcccgtcacaccatgagagccgtcaatacccgaagtccgtagcctaaccgcaaggggggcgcggccgaaggtaggggtggtaat

SEQ ID NO: 844 - DNA, 1013 bp, Eubacterium dolichum
  modified_base (10)..(10): a, c, t, g, unknown or other
  modified_base (14)..(14): a, c, t, g, unknown or other
  modified_base (49)..(49): a, c, t, g, unknown or other
  modified_base (74)..(76): a, c, t, g, unknown or other
atcgtaaagntctntgtaagagaaaaacgatggatataggaaatgatgnccaagtgatggtatcttaccagaannnacggctaactacgtgccagcagccgcggtaatacgtaggtggcaagcgttatccggaatgattgggcgtaaagggtgcgtaggtggtgcattaagtctgaagtaaaagccagcagctcaactgctgtaagctttggaaactggtgtactagagtgcaggagagggcgatggaattccatgtgtagcggtaaaatgcgtagatatatggaggaacaccagtggcgaaggcggtcgcctggcctgtaactgacactgaggcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcgcatgttaccagcattcagttggggactcatgtgagactgccggtgacaaaccggaggaaggtggggatgacgtcaaatcatcatgccccttatggcctgggctacacacgtactacaatggcgtctacaaagaggagcgacacagtgatgtgaagcaaatctcataaaggacgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgca

SEQ ID NO: 845 - DNA, 1394 bp, Eubacterium eligens
  modified_base (19)..(20): a, c, t, g, unknown or other
  modified_base (44)..(45): a, c, t, g, unknown or other
  modified_base (1382)..(1382): a, c, t, g, unknown or other
tcgaacgaagcatttaggnnacagattatttcggtatgaagttnnttatgactgagtggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctggagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccttactgcgggtaaagagagtgtcgttgcctagggacagtggagacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcgaagtcgtgaggccaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgaaaatgcccgaagtcggtgacctaacgnaagaaggagccg

SEQ ID NO: 846 - DNA, 1319 bp, Eubacterium fissicatena
  modified_base (23)..(23): a, c, t, g, unknown or other
  modified_base (43)..(45): a, c, t, g, unknown or other
  modified_base (887)..(887): a, c, t, g, unknown or other
ggattgaagagtgttgcgacggngcggcggacgggtgagtgannngtgggtaacctgcctcatacagggggataacagttagaaatgactgctaataccgcataagaccacggtaccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatcactgacgttgaggctcgaaagcgtggggagcaaacaggattagataccctggtagtccacgccgtaaacgatgaatactagtgtcgggtggcaaagccattcggtgccgcagcaaacgcaataagtattccacctggggagtacgttcgcaagaatgaaactcaaaggaattgacggggacccgcacaagcggtggacatgtggtttaattgaagcaacgcgatagggtgcaagcgctntccagaccacactgaccggcgtgtaatggcgccttcccttcggggcagtggagacaggtggtgcatggttgtcgtcagctcgtgtcgtgagatgttgggttaagtcccgcaacgagcgcaacccttatctttagtagccagcggtttggccgggcactctagagagactgccagggataacctggaggaaggtggggaggacgtcaaatcatcatgccccttatgagcagggctacacacgtgctacaatggcgtaaacaaagggaggcaataccgcgaggttgagcaaatcccaaaaataacgtctcagttcggattgtagtctgcaactcgactacatgaagctggaatcgctagtaatcgcgaatcagaatgtcgcggtgaatacgttcccgggtcttgtacacaccccccgtcacaccatgggagttg

SEQ ID NO: 847 - DNA, 937 bp, Eubacterium hadrum
  modified_base (83)..(83): a, c, t, g, unknown or other
  modified_base (890)..(890): a, c, t, g, unknown or other
  modified_base (903)..(903): a, c, t, g, unknown or other
  modified_base (923)..(923): a, c, t, g, unknown or other
acgaaacaccttatttgattttcttcggaactgaagatttggtgattgagtggcggacgggtgagtaacgcgtgggtaacctnccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaaagtattccacctggggagtacgttcgcaagaatgaaactcaaaggaattgacggggacccgcacaagcggtggagcatgtggtttaattcnaagcaacgcgaanaaccttacctggtcttgacntccttctgaccggt

SEQ ID NO: 848 - DNA, 1342 bp, Eubacterium hallii
caccttttgagattcttcggatgatcgattggtgactgagtggcggacgggtgagtaacgcgtgggtaacctgccctgtacagggggataacagctggaaacggctgctaataccgcataagcgcacgaggagacatctcctagtgtgaaaaactccggtggtacaggatgggcccgcgtctgattagctggttggcagggtaacggcctaccaaggcaacgatcagtagccggtctgagaggatgaacggccacattggaactgagacacggtccaaactcctacgggaggcagcagtggggaatattgcacaatgggggaaaccctgatgcagcaacgccgcgtgagtgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggtgcgtaggtggcagtgcaagtcagatgtgaaaggccggggctcaaccccggagctgcatttgaaactgctcggctagagtacaggagaggcaggcggaattcctagtgtagcggtgaaatgcgtagatattaggaggaacaccagtggcgaaggcggcctgctggactgttactgacactgaggcacgaaagcgtggggagcaaacaggattagataccctggtagtcacgccgtaaacgatgaatactaggtgtcggggccgtataggcttcggtgccgccgcaacgcagtaagtattccacctggggagtacgttggcaagaatgaaactcaaaggaattgacggggacccgcacaagcggtggagcatgtggtttaattcgaagcaacgcgaagaagcttaccaggtcttgacatccttgtgaccgcaccttaatcggggctttccttcgggacagaagagacaggtggtgcatggttgttgtcagctcgtgtcgtgagatgttgggttaagtcccgcaacgagcgcaacccctattttcagtagccagcaggtaaggctgggcactctggagagactgccagggataacctggaggaaggtggggacgacgtcaaatcatcatgccccttatgatctgggcgacacacgtgctacaatggcggtcacagagtgaggcgaacccgcgagggggagcaaaccacaaaaaggccgtcccagttcggactgtagtttgcaacccgactacccgaagctggaatcgctagtaatcgcgaatcagaatgtcgcggtgaatacgttcccgggttttgtaccccccccccgtcacaccctgggagttggaaat

SEQ ID NO: 849 - DNA, 1494 bp, Eubacterium infirmum
gatgaacgctggcggcgtgcctaacacatgcaagtcgagcgagaagtaaagaaatgaagcttcggtagatttcattatggaaagcggcggacgggtgagtaacgcgtaggcaacctgccctgtacagggggatagccacccgaaaaggtgattaataccccatgatgcaagagatacacatgtatcacttgtcaaagatttatcggtatgggatgggcctgcgtctgattagctagttggtagggtaacggcttaccaaggcaacgatcagtagccgacctgagagggtgatcggccacattggaactgagacacggtccaaactcctacgggaggcagcagtggggaatattgcacaatgggggaaaccctgatgcagcaacgccgcgtgaaggaagaaggccttcgggttgtaaacttctgtcctaggggaagaaacaaatgacattacccttggaggaagccccggctaactacgtgccagcagccgcgggtaatacgtagggggcgagcgttatccggaattattgggcgtaaagagtgcgtaggtggcatcttaagcgcagggtttaaggcaatggctcaaccattgttcgccttgcgaactggggtgcttgagtgcaggaggggaaagtggaattcctagtgtagcggtgaaatgcgtagatattaggaggaacaccagtggcgaaggcgactttctggactgttactgacactgaggcacgaaagcgtggggagcaaacaggattagataccctggtagtccacgccgtaaacgatgagcactaggtgtcggggtcgcaagacttcggtgccgcagttaacgcattaagtgctccgcctgggaagtacgcacgcaagtgtaaaactcaaaggaattgacggggacccgcacaagcagcggagcatgtggtttaattcgaagcaacgcgaagaaccttaccaggaacttgacatcctcttgacagatccttaatcggattcttcttcggacaagagagacaggtggtgcatggttgtcgtcagctcgtgtcgtgagatgttgggttaagtcccgcaacgagcgcaacccttgccattagttgccatcatttagttgggcactctagtgggactgccggggaaaactcggaggaaggtggggatgacgtcaaatcatcatgccccttatgttctgggctacacacgtgctacaatggccggtacaacaggcagcgaacccgtgagggggagcgaatcccaaaagccggtcccagttcggactgtaggctgcaactcgcctacacgaagttggagttgctagtaatcgcggatcagaatgccgcggtgaatgcgttcccgggtcttgtacacaccgcccgtcacaccatggaagttgggggtgcccgaagtcggttatttaatctatcgcctaaggcaaaaccaatgactggggtgaagtcgtaaccaaggtagcccgtatcggaaggtgccggctggatcacctcctta

SEQ ID NO: 850 - DNA, 1377 bp, Eubacterium limosum
  modified_base (1310)..(1310): a, c, t, g, unknown or other
gaacgagaagatcagttaagaaccttcgggggaataagtgattggaaagtggcgaacgggtgagtaacgcgtgggtaacctgccctatggaaaggaatagcctcgggaaactgggagtaaagccttatattatggagagatcgcatggtcatttcatgaaaactccggtgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaaaacatgacggtacccaatgaggaagtcccggctaactacgtgccagcagccgcggtaatacgtaggggacaagcgttgtccggaatgactgggcgtaaagggcgcgtaggcggtctgataagtcagatgtgaaaggtaccggctcaaccggtgacgtgcatttgaaactgtcagacttgagtattggagaggcaagtggaattcctagtgtagcggtgaaatgcgtagatattaggaggaacaccagtggcgaaggcggcttgctggacaaatactgacgctgaggtgcgaaagcgtggggagcgaacaggattagataccctggtagtccacgccgtaaacgatgaatgctaggtgttggggaaactcagtgccgcagttaacacaataagcattccgcctggggagtacgaccgcaaggttgaaactcaaaggaattgacggggacccgcacaagcagcggagcatgtggtttaattcgaagcaacgcgaagaaccttaccaggtcttgacgtcctctgacaatcccagagatgggacgtttccttcgggaacagagagacaggtggtgcatggttgtcgtcagctcgtgtcgtgagatgttgggttaagtcccgcaacgagcgcaacccctgcctttagttgccagcattgagttgggcactctagagggactgccgtagacaatacggaggaaggtggggatgacgtcaaatcatcatgccctttatgacctgggctacacacgtgctacaatggtctgatcagagggccgcgaaaccgcgaggtgaagcaaatcccttaaaacagatcccagttcggattgcaggctgcaattcgcctgcatgaagttggagttgctagtaatcgcggatcagaatgccgcggtgaatgcgttcccgggtctngtacacaccgcccgtcacaccacgagagttggcaacacccgaagcctgtgagagaaccgcaaggact

SEQ ID NO: 851 - DNA, 1488 bp, Eubacterium moniliforme
gacgaacgctggcggcgtgcctaacacatgcaagtcgagcgatgaartttccttcgggaaatggattagcggcggacgggtgagtaacacgtgggtaacctgccttgtagaggggaatagccttccgaaaggaagattaataccgcataatattgtactttcgcatgaaagaacaattaaaggagcaatccgctacaagatggacccgcggcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttggggacgataatgacggtacccaaggaggaagccacggctaactacgtgccagcagccgcggtaatacgtaggtggcgagcgttgtccggatttactgggcgtaaagggagcgtaggcggattcttaagtgggatgtgaaatactcgggcttaacctgagtgctgcattccaaactgggaatctagagtgcaggaggggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggtttcaacacctctgtgccgccgctaacgcattaagtattccgcctggggagtacggtcgcaagattaaaactcaaaggaattgacgggggcccgcacaagtagcggagcatgtggtttaattcgaagcaacgcgaagaaccttacctagacttgacatcttctgcattacccttaatcggggaagttccttcgggaacagaatgacaggtggtgcatggttgtcgtcagctcgtgtcgtgagatgttgggttaagtcccgcaacgagcgcaacccctattgttagttgctaccattaagttgagcactctagcgagactgcccgggttaaccgggaggaaggtggggatgacgtcaaatcatcatgccccttatgtctagggctacacacgtgctacaatggcaagtacagagagatgcaataccgtgaggtggagctaaacttcaaaacttgtctcagttcggattgtaggctgaaactcgcctacatgaagctggagttactagtaatcgcgaatcagcatgtcgcggtgaatacgttcccgggccttgtacacaccgcccgtcacaccatgagagttggcaatacccaaagttcgtgagctaacgcgtaagcggggcagcgacctaaggtagggtcagcgattggggtgaagtcgtaacaaggtagccgtaggagaacctgcggctggatcacctccttt

SEQ ID NO: 852 - DNA, 1471 bp, Eubacterium multiforme
agagtttgatcctggctcaggacgaacgctggcggcgtgcctaacacatgcaagtcgagcgatgaagtttcttcgggaaacggattagcggcggacgggtgagtaacacgtgggtaacctgccttgtagagggaaatagccttccgaaaggaagattaataccgcataatattgtaccttcgcatgaaggaacaattaaaggagcaatccgctacaagatggacccgcggcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttgggacgataatgacgtacccaagaaggaagccacggctaactacgtgccagcagccgcggtaatacgtaggtggcgagcgttgtccggatttactgggcgtaaagggagcgtaggcggattcttaagtgggatgtgaaatactcgggctcaacctgagtgctgcattccaaactgggaatctagagtgcaggaggggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggtttaaacacctctgtgccgccctaacgcattaagtattccgcctgggagtacggtcgcaagattaaaactcaaagaaattgacgggggcccgcacaagtagcggagcatgtggtttaattcgaagcaacgcgaagaaccttacctagacttgacatcttctgcattacccttaatcggggaagttcttcgggaacagaatgacaggtggtgcatggttgtcgtcagctcgtgtcgtgagatgttgggttaagtcccgcaacgagcgcaacccctattgttagttgctaccattaagttgagcactctagcgagactgcccgggttaaccgggaggaaggtggggatgacgtcaaatcatcatgccccttatgtctagggctacacacgtgctacaatggcaagtacagagagatgcaataccgtgagtggagctaaacttcaaaacttgtctcagttcggattgtaggctgaaactcgcctacatgaagctggagttactagtaatcgcgaatcagcatgtcgcggtgaatacgttcccgggccttgtacacaccgcccgtcacaccatgagagttggcaatacccaaagttcgtgagctaacgcgtaagcaggggcagccacctaaggtagggtcagccatttgggtgaagtcgttaacaaggtaacc

SEQ ID NO: 853 - DNA, 1477 bp, Eubacterium nitritogenes
agagtttgatcctggctcaggacgaacgctggcggcgtgcctaacacatgcaagtcgagcgatgaagtttccttcgggaaacggattaccgccggacgggtgagtaacacgtgggtaacctgcctcatagaggggaatagcctcccgaaagggagattaataccgcataacattgcagtttcgcatgaaacagcaattaaaggagcaatccgctatgagatggacccgcggcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttgggacgataatgacgtacccaaggaggaagccacggctaactacgtgccagcagccgcggtaatacgtaggtggcgagcgttgtccggatttactgggcgtaaagggagcgtaggcggatttttaagtgggatgtgaaatacccgggctcaacctgggtgctgcattccaaactgggaatctagagtgcaggaggggagagtggaattcctagtgtagcggtgaaatgcgtagagattaggaagaacaccagtggcgaaggcgactctctggactgtaactgacgctgaggctcgaaagcgtggggagcgaacaggattagataccctggtagtccacgccgtaaacgataaatactaggtgtaggggtttaaacacctctgtgccgccctaacgcattaagtatcccgcctgggaagtacggtcgcaagattaaaactcaaaggaattgacgggggcccgcacaagtagcggagcatgtggtttaattcgaagcaacgcgaagaaccttacctagacttgacatcctctgcattacccttaatcggggaagttcttcgggaacagagtgacaggtggtgcatggttgtcgtcagctcgtgtcgtgagatgttgggttaagtcccgcaacgagcgcaacccctattgttagttgctaccattaagttgagcactctagcgagactgcctgggttaaccaggaggaaggtggggatgacgtcaaatcatcatgccccttatgtctagggctacacacgtgctacaatggcaagtacagagagatgcaataccgcgaggtggagctaaacttcaaaactcgtctcagttcggattgtaggctgaaactcgcctacatgaagctggagttactagtaatccgcgaatcagcatgtcgcggtgaatacgttcccgggccttgtacacaccgcccgtcacaccatgagagttggcaatacccaaagttcgtgagctaacgcgtaagcaggggcagccacctaaggtagggttcagccatttggcctgaagtgcgtaacaaggtaacc

SEQ ID NO: 854 - DNA, 1351 bp, Eubacterium nodatum
gatgaacgctggcggcgtgcctaacacatgcaagttgagcgagaaatcacttaaagaagcttcggtagacttaagagatggagagcagcggacgggtgaggaacgcgtgggaaacctgcccttgacaggaggatagccgagagaaatttcgatttaatacttcataaagcagagcattcgcatggatgaactgccaaagaattatcggtcaaggatggtccagcgtctgattagctggttggtaaggtaccggcttaccaaggcgacgatcagtagccggcctgagagggtgaacggccacattggaactgagacacggtccagactctacgggaggcagcagtggggaatattgcacaatgggcgaagcctgatgcagcaacgccgcgtgaaggaagaaggctttcgagtcgtaaacttctgtccaaagggaagaataatgacggtacctttgaagaaagccccggctaactacgtgccagcagccgcggtaatacgtagggggcgagcgttatccggaattactgggcgtaaagagtatgtaggtggttaagtaagcgtagggtttaaggcgacagcccaactgtcgtatgccccgcgagctgtttaacttgagtacaggaggggaaggcggaattcctagtgtagcgctgaaatgcgtagatattaggaggaacaccagtggcgaaggcggccttctggactgtaactgacactgagatacgaaagcgtgggtagcaaacaggattagataccctggtagtccacgccgtaaacgatgagcactaggtgtcgggctcgcaagagttcggtgccggagcaaacgcattaagtgctccgcctggggagtacgcacgcaagtgtgaaactcaaaggaattgacggggacccgcacaagcagcggagcatgtggtttaattcgaagcaacgcgaagaaccttaccaggacttgacatcccactgaaagctcggttaaaactgagcccttcttcggaacagtggagacaggtggtgcatggttgtcgtcagctcgtgtcgtgagatgttgggttaagtcccgcaacgagcgcaacccttgccgttagttgccatcattaagttgggcactctaatgggactgccggggagaacccggaggaaggcggggatgacgtcaaatcatcatgccccttatgttctgggctacacacgtgctacaatggccgtcacagagggaagcgagagagcgatcttaagcgaaaccaaaaaggcggtcccagttcggactgcaggctgcaactcgcctgcacgaagccggagttgctagtaatcgcggatcagaatgtcgcggtgaatgcgttcccgggtcttg

SEQ ID NO: 855 - DNA, 1386 bp, Eubacterium ramulus
  modified_base (1339)..(1339): a, c, t, g, unknown or other
gcactttacctgatttccttcggggatgattgttctgtgactgagtggcggacgggtgagtaacgcgtggataacctgcctcacacagggggataacagttggaaacggctgctaataccgcataagcgcacagcaccgcatggtgcagtgtgaaaaactccggtggtgtgagatggatccgcgtctgattagcttgttggcggggtaacggcccaccaaggcgacgatcagtagccggcctgagagggcgaccggccacattgggactgagacacggcccagactcctacgggaggcagcagtggggaatattgcacaatgggggaaaccctgatgcagcgacgccgcgtgagcgatgaagtatttcggtatgtaaagctctatcagcagggaagataatgacggtacctgactaagaagctccggctaaatacgtgccagcagccgcggtaatacgtatggagcaagcgttatccggatttactgggtgtaaagggagcgtaggcggtcctgcaagtctgatgtgaaaggccggggctcaaccccgggactgcattggaaactgtaggactagagtgtcggaggggtaagtggaattcctagtgtagcggtgaaatgcgtagatattaggaggaacaccagtggcgaaggcggcttactggacgactactgacgctgaggctcgaaagcgtggggagcaaacaggattagataccctggtagtccacgccgtaaacgatgaatactaggtgttggcaggtaagacctgtcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacctcccggtgacagatgaaagaccgggttttcccttcggggcaccggtgacaggtggtgcatggttgtcgtcagctcgtgtcgtgagatgttgggttaagtcccgcaacgagcgcaacccttatccccagtagccagcatttcggatgggcactctgtggagactgccagggacaacctggaggaaggtggggatgacgtcaaatcatcatgccccttatgacttgggctacacacgtgctacaatggcgtaaacaaagggaagcgagaccgcgaggtggagcaaatcccaaaaataacgtcccagttcggattgtagtctgcaactcgactacatgaagctggaatcgctagtaatcgcagatcagaatgctgcggtgaatacgttcccgggtcttgtacacaccgcccgtcacaccatgggnagtcggaaatgcccgaagccggtggcctaaccgcaaggaaggagccg

SEQ ID NO: 856 - DNA, 1387 bp, Eubacterium rectale
tcgaacgaagcactttatttgatttccttcgggactgattattttgtgactgagtggcggacgggtgagtaacgcgtgggtaacctgccttgtacagggggataacagttggaaacggctgctaataccgcataagcgcacagcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgttgggaagcattgcttctcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggtacttaaccgtaccttctcttcggagcaggagtgacaggtggtgcatggttgtcgtcagctcgtgtcgtgagatgttgggttaagtcccgcaacgagcgcaacccttatctttagtagccagcggtccggccgggcactctagagagactgccagggataacctggaggaaggcggggatgacgtcaaatcatcatgccccttatgacttgggctacacacgtgctacaatggcgtaaacaaagggaagcaaagctgtgaagccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttgggaatgcccgaagccagtgacctaaccgaaaggaa

SEQ ID NO: 857 - DNA, 929 bp, Eubacterium ruminantium
  modified_base (12)..(15): a, c, t, g, unknown or other
  modified_base (36)..(36): a, c, t, g, unknown or other
tcgaacgaagannnnctggagtgcttgcacttgganggactgagtggcggacgggtgagtaacgcgtgggtaacctgccttatacagggggataacagttggaaacgactgctaataccgcataagcgcacggtatcgcatgatacagtgtgaaaaactccggtggtataagatggacccgcgtctgattagcttgttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaaactctatcagcagggaagataatgacggtacctgactaagaagcaccggctaaatacgtgccagcagccgcggtaatacgtatggtgcaagcgttatccggatttactgggtgtaaagggtgcgtaggtggtatggcaagtcagaagtgaaaggctggggctcaaccccgggactgcttttgaaactgtcaaactagagtacaggagaggaaagcggaattcctagtgtagcggtgaaatgcgtagatattaggaggaacaccagtggcgaaggcggctttctggactgaaactgacactgaggcacgaaagcgtggggagcaaacaggattagataccctggtagtccacgccgtaaacgatgaatactaggtgtcgggcagcatagctgttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccaggtcttgacatcccgatgaccgc

SEQ ID NO: 858 - DNA, 1384 bp, Eubacterium saburreum
  modified_base (17)..(18): a, c, t, g, unknown or other
  modified_base (1375)..(1375): a, c, t, g, unknown or other
tcgaacgaagctgttannaggaagtcttcggatggaattttaacagacttagtggcggacgggtgagtaacgcgtggataacctgccttatacagggggataacggagagaaatttccgctaagaccgcataagaccacagcaccgcatggtgcaggggtaaaatattaataggtataagatggatccgcgtccgattagcttgttggtgaggtagaggctcaccaaggcgacgatcggtagccggcctgagagggtgaacggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgcagacggccaagcaagtctgaagtgaaatgcatgggctcaacccatgaattgctttggaaactgttggcttgagtgtcggaggggtaagcggaattcctagtgtagcggtgaaatgcgtagatattaggaggaacaccggaggcgaaggcggcttactggacgacaactgacgttgaggctcgaaggcgtggggagcaaacaggattagataccctggtagtccacgcagtaaacgatgaatacttggtgtcggggagataaactcttcggtgccgcaagcaaacgcattaagtattccacctggggagtacgttcgcaagaatgaaactcaaaggaattgacggggacccgcacaagcggtggagcatgtggtttaattcgaagcaacgcgaagaaccttaccaaatcttgacatactcttgaatagttttgtaatgagactagtctttcgggacaagggatacaggtggtgcatggttgtcgtcagctcgtgtcgtgagatgttgggttaagtcccgcaacgagcgcaacccttgtcgtcagtagccagcagtaagatgggcactctgacgagacagccggagataatccggaggaaggtggggatgacgtcaaatcatcatgccccttatgatttgggctacacacgtgctacaatggcgtaaacaaagtgaagcaagaccgcgaggttaagcaaatcacagaaataacgtctcagttcggattgtagtctgcaactcgactatatgaagccggaatcgctagtaatcgcagatcagaatgctgcggtgaatacgttcccgggtcttgtacacaccgcccgtcacaccatgggagtcatcaatgcccgaagtcagtgacctanccgtaagga

SEQ ID NO: 859 - DNA, 1343 bp, Eubacterium saphenum
gatgaacgctggcggcgtgcttaacacatgcaagtcgagcgagaaactacatgcagacacttcggtagaagcgagtagcggaaagcggcggacgggtgagtaacgcgtggcaacctgcccttcacagaggtatagcctcgggaaaccgggattaaaaccacataaaatcataggttcgcatgaaccaaaggtcaaagatttatcggtgaaggatgggcctgcgtctgattagctggttggtagggtaaaagcctaccaaggcgacgatcagtagccgacctgagagggtgatcggccacattggaactgagacacggtccaaactctacgggaggcagcagtgggggatattgcacaatgggggaaaccctgatgcagcaacgccgcgtgaggtatgaaggcctttgggttgtaagcctctgtcctaggggaagaaaaaaatgacggtacccgaggaggaagccccggctaactacgtgccagcagccgcggtaatacgtagggggcaagcgttatccggaattattgggcgtaaagagtgcgtaggtggtctactaagcgcggggtgaaaggcaatggctcaaccattgttagccttgcgaactggcagacttgagtgcaagagaggaaagcggaattcctagtgtagcggtgaaatgcgcagatattaggaggaacaccggcggcgaaggcggctttctggattgtaactgacactgaggcacgaaagcgtgggtagcaaacaggattagataccctggtagtccacgccgtaaacgacgagcactaggtgtcgggacatgagtctcggtgccgcagttaacgcaataagtgtccgcctggggagtacgcacgcaagtgtaaaactcaaaggaattgacggggacctgcgcaagcagcggagcatgtggtttaattcgaagcaacgcgaagaaccttaccaagacttgacatccctctgacgtacccttaatcgggtatttcttcggacagaggagacaggtggtgcatggttgtcgtcagctcgtgtcgtgagatgttgggttaagtcccgcaacgagcgcaacccttgtctttagttgccatcattaagttgggcactctaaagagactgccggggaaactcggaggaaggtggggatgacgtcaaatcatcatgccccttatgtcttgggctacacacgtgctacaatggccggtacaaagagaagcgataccgcaagggggagcaaatcttaaaaaccggtcccagttcggattgcaggctgcaactcgcctgcatgaagtcggagttgctagtaatcgcagatcagaatgctgcggtgaatgcgttcccgggtctt

SEQ ID NO: 860 - DNA, 1368 bp, Eubacterium siraeum
  modified_base (901)..(901): a, c, t, g, unknown or other
gtcgaacggtgaagaggagcttgctcctcggaacagtggcggacgggtgagtaacacgtgagcaacctggctctaagagggggacaacagttggaaacgactgctaataccgcataacgtatcgggatggcatcttcctgataccaaagattttatcgcttagagatgggctcgcgtctgattagatagttggcggggtaacggcccaccaagtcgacgatcagtagccggactgagaggttgaacggccacattgggactgagacacggcccagactcctacgggaggcagcagtgggggatattggacaatgggggcaaccctgatccagcgacgccgcgtgagggaagaaggttttcggattgtaaacctctgttgacggagaaaaaaatgatggtatccgtttagaaagccacggctaactacgtgccagcagccgcggtaatacgtaggtggcaagcgttgtccggaattactgggtgtaaagggagtgtaggcgggatatcaagtagaagtgaaaattacgggctcaactcgtaacctgcttttgaaactgacattcttgagtgaagtagaggcaagcggaattcctagtgtagcggtgaaatgcgtagatattaggaggaacaccagtggcgaaggcggcttgctgggcttttactgacgctgaggctcgaaagcgtggggagcaaacaggattagataccctggtagtccacgccgtaaacgatgattactaggtgtggggggattgaccccttccgtgccggagtaaacacaataagtaatccacctggggagtacgaccgcaaggttgaaactcaaaggaattgacgggggcccgcacaagcagtggagtatgtggtttaattcgacgcaacgcgaagaaccttaccagtnataagtgaaaattaccggctcaactcgtaagcttttccttaaggggacataattgagggaggtagaggcaagcggaaagctcgtgtcgtgagatgttgggttaagtcccgcaacgagcgcaacccttatcattagttgctacgcaagagcactctaatgagactgccgttgacaaaacggaggaaggtggggatgacgtcaaatcatcatgccctttatgacctgggctacacacgtactacaatggcgtttaacaaagagaagcaaagccgcgaggcagagcaaatctccaaaaaacgtctcagttcggattgtaggctgcaactcgcctacatgaagtcggaattgctagtaatcgtaggtcagcatactacggtgaatacgttcccgggccttgtacacaccgcccgtcaaaccatgagagttggcaacacccgaagtcggtagtctaaccgcaaggaggacgc

SEQ ID NO: 861 - DNA, 965 bp, Eubacterium sp.
  3_1_31
  modified_base (39)..(39): a, c, t, g, unknown or other
  modified_base (41)..(41): a, c, t, g, unknown or other
  modified_base (842)..(842): a, c, t, g, unknown or other
  modified_base (875)..(875): a, c, t, g, unknown or other
  modified_base (904)..(904): a, c, t, g, unknown or other
  modified_base (915)..(915): a, c, t, g, unknown or other
  modified_base (934)..(934): a, c, t, g, unknown or other
tttaggaagcttgcttccaaagagacttagtggcgaacngntgagtaacacgtaggtaacctgcccatgtgcccgggataactgctggaaacggtagctaaaaccggataggtatgagggaggcatcttcctcatattaaagcaccttcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtgaagaaggtcttcggatcgtaaagcactgttgtaagtgaagaatgccatatagaggaaatgctatgtgggtgacggtagcttaccagaaagccacggctaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcanaggaattgacgggggcccgcacaagcggtggantatgtggtttaattcgaagcaacgcgaanaaccttaccangccttgacatggatataantgttctagagatagaaagatagctatatatc

SEQ ID NO: 862 - DNA, 1229 bp, Eubacterium sp.
  AS15b
tgagtttgatcctggctcaggatgaacgctggcggcgtgcctaacacatgcaagtcgaacgagtggcggacgggtgagtaacgcgtaagtaatcaacctgtgacacacggataactgatagaaatgtcagctaatacgagatgaacaaaggcggtcacagacgagcttgcgtctgattagctagttggtggggtaagagcctaccaaggcgacgatcagtagccggcctgagagggtgaacggccacattggaactgagacacggtccaaactcctacgggaggcagcagtgggggatattgcacaatggggggaaccctgatgcagcaacgccgcgtgagtgaagaaggccctagggtcgtaaagctctgtcgtatgggaagatgactgtaccatacaagaaagccccggctaactacgtgccagcagccgcggtaatacgtagggggcaagcgttatccggaattactgggcgtaaagggtgcgtaggcggctagttaagtcgaggttaaaaggcagtagctcaactactgttgggccttgaaactaattagcttgagtataggagaggaaagtggaattcccggtgtggcggtgaaatgcgtagatatcgggaggaataccggtggcgaaggcgactttctggactaactgacgctgaggcacgaaagcgtgggtagcaaacaggattagataccctggtagtccacgccgtaaacgatgaacactaggtgtcgggatttcggtgccggcgcaaacgcaataagtgttccgcctggggagtacgttcgcaagaataaaactcaaaggaattgacggggacccgcacaagtagcggagcatgtggtttaattcgaagcaacgcgaagaaccttacctaagcttgacatgcacaggtggtgcatggttgtcgtcagctcgtgtcgtgagatgttgggttaagtcccgcaacgagcgcaacccctattgatagttgccagtgcgtaggcactctatcaagacagttatggataacataaaggaaggtggggatgacgtcaaatcatcatgccccttatgcttagggctacacacgtgctacaatggctgtcaaagagaagcaaggtcgcaaggcggagcaaacctgaagcagtccaagttcggatgtgggctgaaactcgcccacagaagtcggagttactagtaatcgcgaatcagaatgtcgcggtgaatgcgttcccgggtcttgt

SEQ ID NO: 863 - DNA, 1253 bp, Eubacterium sp.
  OBRC9
  modified_base (1234)..(1234): a, c, t, g, unknown or other
agtggcggacgggtgagtaacgcgtaagtaatcaacctgtgacacacggataactgatagaaatgtcagctaatacgagatgaacaaaggcggtcacagacgagcttgcgtctgattagctagttggtggggtaagagcctaccaaggcgacgatcagtagccggcctgagagggtgaacggccacattggaactgagacacggtccaaactcctacgggaggcagcagtgggggatattgcacaatggggggaaccctgatgcagcaacgccgcgtgagtgaagaaggccctagggtcgtaaagctctgtcgtatgggaagatgactgtaccatacaagaaagccccggctaactacgtgccagcagccgcggtaatacgtagggggcaagcgttatccggaattactgggcgtaaagggtgcgtaggcggctagttaagtcgaggttaaaaggcagtggctcaactactgttgggccttgaaactaattagcttgagtataggagaggaaagtggaattcccggtgtagcggtgaaatgcgtagatatcgggaggaataccggtggcgaaggcgactttctggactaactgacgctgaggcacgaaagcgtgggtagcaaacaggattagataccctggtagtccacgccgtaaacgatgaacactaggtgtcgggatttcggtgccggcgcaaacgcaataagtgttccgcctggggagtacgttcgcaagaataaaactcaaaggaattgacggggacccgcacaagtagcggagcatgtggtttaattcgaagcaacgcgaagaaccttacctaagcttgacatgcacaggtggtgcatggttgtcgtcagctcgtgtcgtgagatgttgggttaagtcccgcaacgagcgcaacccctattgatagttgccagtacgtaggcactctattaagacagttatggataacataaaggaaggtggggatgacgtcaaatcatcatgccccttatgcttagggctacacacgtgctacaatggctgtcaaagagaagcaaggtcgtaaggcggagcaaacctgaagcagtccaagttcggatgtgggctgaaactcgcccacagaagtcggagttactagtaatcgcgaatcagaatgtcgcggtgaatgcgttcccgggtcttgtacacaccgcccgtcacaccatgggagctgagggtacccaaagtcagtatctaagaagctgcctaangtaaacttagtgactgggg

SEQ ID NO: 864 - DNA, 1371 bp, Eubacterium sp.
  WAL 14571
  modified_base (925)..(925): a, c, t, g, unknown or other
  modified_base (1268)..(1268): a, c, t, g, unknown or other
tcgagcgagaagccattgactgaaacttcggtagaaggatatggtggaaagcggcggacgggtgagtaacgcgtaggcaacctgccccttacagagggatagccattggaaacgatgattaaaacctcataacgcatcccccccacatggaggggaagccaaagattcatcggtaagggatgggcctgcgtctgattagcttgttggcggggtaacggcccaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagggatgaaggccttcgggtcgtaaacctctgtccttggggaagaaacaaatgacggtacccatggaggaagccccggctaactacgtgccagcagccgcggtaatacgtagggggcgagcgttatccggaattattgggcgtaaagagtgcgtaggtggttacctaagcgcagggtctaaggcaatggctcaaccattgttcgccctgcgaactgggctacttgagtgcaggagaggaaagcggaattcctagtgtagcggtgaaatgcgtagatattaggaggaacaccagtggcgaaggcggctttctggactgttactgacactgaggcacgaaagcgtggggagcaaacaggattagataccctggtagtccacgccgtaaacgatgagcactaggtgtcggggccgcaaggcttcggtgccgcagttaacgcattaagtgctccgcctggggagtacgcacgcaagtgtgaaactcaaaggaattgacggggacccgcacaagcagcggagcatgtggtttaattcgaagcaacgcgaagaagcttaaccagtgttcgccntccgaactgggctacctaaccggatccttcttcggacagtggagacaggtggtgcatggttgtcgtcagctcgtgtcgtgagatgttgggttaagtcccgcaacgagcgcaacccttgccattagttgccatcattcagttgggcactctaatgggactgccggggacaactcggaggaaggtggggatgacgtcaaatcatcatgccccttatgttctgggctacacacgtgctacaatggccggtacagcaagaagcaaaaccgcgaggtggagcaaatctcaaaaaccggtcccagttcggactgcaggctgaaacccgcctgcacgaagccggagttgntagtaatcgtggatcagaatgccacggtgaatgcgttcccgggtcttgtacacaccgcccgtcacaccatggaagttgggggtgcccgaagccggcagggaaa

SEQ ID NO: 865 - DNA, 1363 bp, Eubacterium sp.
  oral clone GI038
gagtttgattctggctcaggatgaacgctggcggcgtgcctaacacatgcaagtcgaacgagtggcggacgggtgagtaacgcgtgggcaacctgccccataccgggggatagcagttggaaacggctggtaaaaccgcataagaaaaagtggtatgggatgggcccgcgtctgattagccagttggtgaggtaacggctcaccaaagcgacgatcagtagccggcctgagagggcggacggccacattgggactgagacacggcccagactcctacgggaggcagcagtgggggatattgcacaatggaggaaactctgatgcagcgacgccgcgtgagtgaagaagtatttcggtatgtaaagctctatcagcagggaagatgacggtacctgagtaagaagctccggctaaatacgtgccagcagccgcggtaatacgtatggagcaagcgttatccggatttactgggtgtaaagggagcgcagacggatatgcaagtctgaagtgaaaccccacggctcaaccgtgggcttgctttggaaactgtagatctagagtactggagaggtaagcggaattcctggtgtagcggtgaaatgcgtagatatcaggaagaacatcggcggcgaaggcggcttactggacagactgacgttgaggctcgaaggcgtggggagcaaacaggattagataccctggtagcccacgcggtaaacgatgaatactaggtgttgggatttcagtgccgaagcaaacgtgataagtattccacctggggagtacgttcgcaagaatgaaactcaaaggaattgacggggacccgcacaagcggtggagcatgtggtttaattcgaagcaacgcgaagaaccttaccagaccttgaatcgacaggtggtgcatggttgtcgtcagctcgtgtcgtgagatgttgggttaagtcccgcaacgagcgcaacccttgcgtatagtagccagcaattgggaactctatacggactgccggggataacccggaggaaggtggggatgacgtcaaatcatcatgccccttatggtctgggctacacacgtgctacaatgtcgcagagggaagcgaaagggtgacctgaagcgaatctcaaaacgacccagttcggatgcaggctgcaacccgcctgcagaagctggaatcgctagtaatcgcgaatcagcatgtcgcggtgaatacgttcccgggtcttgtacacaccgcccgtcacaccatgggagtcgggaatgcccgaagccggtacctaaggagccgtcgaaggcaggccggatgactggggtgaagtcgtaacaaggtagccgtaggagaacctgcggctggaacacctcctt

SEQ ID NO: 866 - DNA, 1364 bp, Eubacterium sp.
  oral clone IR009
gagtttgatcctggctcaggatgaacgcgggcggcatgcttaacacatgcaagtcgaacgagtggcggacgggtgagtaacgcgtggataacctgccttatacagggggataacggagagaaatttccgctaagaccgcataagaaaattaggtataagatggatccgcgtccgattagcttgttggtgaggtagaggctcaccaaggcgacgatcggtagccggcccgagagggtgaacggccacattgggactgagacacggcccaaactcctacgggaggcagcagtggggaatattggacaatgggggaaaccctgatccagcgacgccgcgtgagtgaagaagtatttcggtatgtaaagctctatcagcagggaagatgacggtacctgactaagaagccccggctaactacgtgccagcagccgcggtaatacgtagggggcaagcgttatccggatttactgggtgtaaagggagcgcagacggccaagcaagtctgaagtgaaatgcatgggctcaacccatgaattgctttggaaactgttaggcttgagtgtcggaggggtaagcggaattcctagtgtagcggtgaaatgcgtagatattaggaggaacaccggaggcgaaggcggcttactggacgaactgacgttgaggctcgaaggcgtggggagcaaacaggattagataccctggtagtccacgcagtaaacgatgaatacttggtgtcggggcttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccaaatcttgacatatacaggtggtgcatggttgtcgtcagctcgtgtcgtgagatgttgggttaagtcccgcaacgagcgcaacccttgtcgtcagtagccagcatgggaactctgacgagacagccggagataatccggaggaaggtggggatgacgtcaaatcatcatgccccttatgatttgggctacacacatgctacaatggcgtacaaagtgaagcaagaccgcgaggttaagcaaatcacagaacgtctcagttcggatgtagtctgcaactcgactatagaagccggaatcgctagtaatcgcagatcagaatgctgcggtgaatacgttcccgggtcttgtacacaccgcccgtcacaccatgggagtcatcaatgcccgaagtcagtacctaaggagctgccgaaggcagggaggataactggggtgaagtcgtaacaaggtagccgtatcggaaggtgcggttggatcacctcctt

SEQ ID NO: 867 - DNA, 1360 bp, Eubacterium sp.
  oral clone JH012
ggagtttgatcctggctcaggaggaacgctggcggcgtgcctaacacatgcaagtcgagcgagcggcggacgggtgagtaacgcgtaggcaacctgccctttgcacagggatagcctcgggaaaccgggattaaaacctgataatcaaattaggcaaaggatgggcctgcgtctgattagcttgttggtgaggtaacggctcaccaaggcgacgatcagtagccgacctgagagggtaaacggccacattggaactgagacacggtccaaactcctacgggaggcagcagtggggaatattgcacaatgggcgaaagcctgatgcagcaacgccgcgtgagtgaagaaggcccttgggtcgtaaaactctgttgagagggaagatgacggtacctcttgaggaagccccggctaactacgtgccagcagccgcggtaatacgtagggggcgagcgttatccggaattattgggcgtaaagagtgcgtaggtggttatctaagcgtggggtgaaaggcagtggcttaaccattgtaagccttgcgaactggatagcttgagtgcaggaggggaaagtggaattcctagtgtagcggtgaaatgcgtagatattaggaggaacaccggtggcgaaggcggctttctggactgactgacactgaggcacgaaagcgtgggtagcaaacaggattagataccctggtagtccacgccgtaaacgatgagcactaggtgttggggcctcagtgccgcagttaacgcaataagtgctccgcctggggagtacgcacgcaagtgtaaaactcaaaggaattgacggggacccgcacaagcagcggagcatgtggtttaattcgaagcaacgcgaagaaccttaccaggacttgacatcgacaggtggtgcatggttgtcgtcagctcgtgtcgtgagatgttgggttaagtcccgcaacgagcgcaacccttgtcaatagttgccagcatgggcactctattgagactgccgtggataacacggaggaaggtggggatgacgtcaaatcatcatgccccttatgttttgggctacacacgtgctacaatggccggcaacgagaagcaagaccgcaaggtggagcaaaacttaaccggtcccagttcggatgtaggctgcaactcgcctacagaagatggagttgctagtaatcgcagatcagaatgctgcggtgaatgcgttcccgggtcttgtacacaccgcccgtcacaccatggaagttgggggtgcccgaagtcggttaggagctgccgaaggcaaaaccaatgactggggtgaagtcgtaacaaggtagccgtatcggaaggtgcggctggatcacctcctt

SEQ ID NO: 868 - DNA, 1365 bp, Eubacterium sp.
  oral clone JI012
ggagtttgattctggctcaggatgaacgctggcggcgtgcttaacacatgcaagtcgaacgagtggcggacgggtgagtaacgcgtgggcaacctgccttatacagggggataacagagagaaatttccgctaataccccataagaaaagttggtataagatggacccgcgtctgattagctggttggtgaggtaaaggctcaccaaggcgacgatcagtagccggcctgagagggtgaacggccacattgggactgagacacggcccaaactcctacgggaggcagcagtggggaatattggacaatggggggaaccctgatccagcgacgccgcgtgagtgaagaagtatttcggtatgtaaagctctatcagcagggaagatgacggtacctgactaagaagccccggctaactacgtgccagcagccgcggtaatacgtagggggcaagcgttatccggatttactgggtgtaaagggagcgtagacggtactgcaagtctggagtgaaacccgcgggctcaacctgcggcatgctttggaaactgtggtactggagtgtcggagaggtaagcggaattcccagtgtagcggtgaaatgcgtagatattgggaagaacacctggggcgaaggcggcttactggacgaactgacgttgaggctcgaaggcgtggggagcaaacaggattagataccctggtagtccacgcagtaaacgatgaatactaggtgtcgggatttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatatacaggtggtgcatggttgtcgtcagctcgtgtcgtgagatgttgggttaagtcccgcaacgagcgcaacccttgtgatcagtagccagcatggggactctgatcagacagccggagataatccggaggaaggtggggatgacgtcaaatcatcatgccccttatgatttgggctacacacgtgctacaatggcggacaaagagaagcgagtgtgcgaacataagcaaacctcaagccgtctcagttcggatgtagtctgcaactcgactatagaagctggaatcgctagtaatcgcaaatcagaatgttgcggtgaatacgttcccgggtcttgtacacaccgcccgtcacaccatgggagtcatcaatgcccgaagtcagtacctaaggagctgccgaaggcagggaggataactggggtgaagtcgtaacaaggtagccgtatcggaaggtgcggctggatcacctcctt

SEQ ID NO: 869 - DNA, 1364 bp, Eubacterium sp.
  oral clone JN088
gagtttgattctggctcaggatgaacgctggcggcgtgcctaacacatgcaagtcgaacgagtggcggacgggtgagtaacacgtgggtaacctgccttatggagggggataacagagagaaatcactgctaataccgcataagaaaagtcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagatgacagtacctgactaataagccccggctaactacgtgccagcagccgcggtaatacgtatggggcgagcgttatccggatttactgggtgtaaagggagcgtagacggaatggcaagtctgaagtgaaatacccgggctcaacctggggactgctttggaaactgttgttctacagtgttggagaggtaagtggaattcctggtgtagcggtgaaatgcgtatatatcaagaagaacaccggaggcgaaggcggcttactggacaaactgacgttgaggctcgaaagcgtggggatcaaacaggattagataccctggtattccacgctgtaaacgatgaatactaggtgtcggggtctcggtgccgtcgctaacgcaataagtattccacctggggagtacgttcgcaagaatgaaactcataggaattgacggggacccgcacaagcggtggagcatgtggtttaattcgaagcaacgcgaagaaccttaccaagtcttgagatcgacaggtggtgcatggttgtcgtcagctcgtgtcgtgagatgttgggttaagtcccgcaacgagcgcaacccctatagttagtatccagcatgggcactctaactagactgccagggataacctggaggaaggcggggatgacgtccaatcatcatgccccttatgacttgggctacacacgtgctacaatggcgtacaaagggaagcgagagggtgaccttaagcaaatctcaaaacgtctcagttcggatgtagtctgcaacccgactacagaagctggaatcgctagtaatcgcagatcagcatgctgcggtgaatacgttcccgggtcttgtacacaccgcccgtcacaccatgggagttggtaatgcccgaagtcagttcccagggagctgccgaaggcaggactgatgactggggtgaagtcataacaaggtagccgtatcggaaggtgcggctggatcacctcctt

SEQ ID NO: 870 - DNA, 1354 bp, Eubacterium sp.
  oral clone JS001
ggagtttgatcctggctcaggatgaacgctggcggcgtgcctaacacatgcaagtcgagcgagcggcggacgggtgagtaacgcgtaggcaacctacccttcacccagggacagcctccggaaacggggattaatacctgatgaccaaagttggtgagggatgggcctgcgtctgattagttagttggtgaggtaacggctcaccaaggcgacgatcagtagccgacctgagagggtgaccggccacattggaactgagacacggtccagactcctgcgggaggcagcagtggggaatattgcacaatgggcgaaagcctgatgcagcaacgccgcgtgaaggatgaaggtccttggattgtaaacttctgtccatagggaagatgacggtacctatggaggaagccccggctaactacgtgccagcagccgcggtaatacgtagggggcaagcgttatccggaattattgggcgtaaagcgtgcgtaggcggctttttaagcgtggggtttaaggctatggctcaaccatagtatgccctgcgaactggaaggcttgagtacaggagaggaaagcggaattcctagtgtagcggtgaaatgcgtagatattaggaggaacaccagtggcgaaggcggctttctggactgactgacgctgaggtacgaaagcgtggggagcaaacaggattagataccctggtagtccacgctgtaaacgatgagcactaggtgtcggggcttcggtgccgcagttaacgcaataagtgctccgcctggggagtacgttcgcaagaatgaaactcaaaggaattgacggggacccgcacaagcagcggagcatgtggtttaattcgaagcaacgcgaagaaccttaccaggacttgacatcgacaggtggtgcatggttgtcgtcagctcgtgtcgtgagatgttgggttaagtcccgcaacgagcgcaacccttgttactagttgccatcatgggcactctagtgagactgccggggacaactcggaggaaggtggggatgacgtcaaatcatcatgccccttatgttctgggctacacacgtgctacaatggctggcaaagagaagcgagaccgtgaggtggagcaaaactcaccagccccagttcggatgcaggctgcaactcgcctgcagaagccggagttgctagtaatcgcagatcagaatgctgcggtgaatgcgttcccgggtcttgtacacaccgcccgtcacaccatggaagttgggggcgcccgaagttggtattacctaaggcgaaaccgatgactggggtgaagtcgtaacaaggtagccgtaggagaacctgcggctggatcacctcctt

SEQ ID NO: 871 - DNA, 1427 bp, Eubacterium sp.
  oral clone OH3A
  modified_base (11)..(11): a, c, t, g, unknown or other
tcgacgaaggnatatataggaagtcttcggatggaatatgtataacttagtggcggacgggtgagtaacgcgtaagtaatcaacctgtgacacacggataactgatagaaatgtcagctaatacgagatgaactgtttaaattgggaaatggaaacagcaaagcgaaagcggtcacagacgagcttgcgtctgattagctagttggtggggtaagagcctaccaaggcgacgatcagtagccggcctgagagggtgaacggccacattggaactgagacacggtccaaactcctacgggaggcagcagtgggggatattgcacaatggggggaaccctgatgcagcaacgccgcgtgagtgaagaaggccctagggtcgtaaagctctgtcgtatgggaagaaacaaatgactgtaccatacaagaaagccccggctaactacgtgccagcagccgcggtaatacgtagggggcaagcgttatccggaattactgggcgtaaagggtgcgtaggcggctagttaagtcgaggttaaaaggcagtagctcaactactgttgggccttgaaactaattagcttgagtataggagaggaaagtggaattcccggtgtagcggtgaaatgcgtagatatcgggaggaataccggtggcgaaggcgactttctggactataactgacgctgaggcacgaaagcgtgggtagcaaacaggattagataccctggtagtccacgccgtaaacgatgaacactaggtgtcgggaggaatttcggtgccggcgcaaacgcaataagtgttccgcctggggagtacgttcgcaagaataaaactcaaaggaattgacggggacccgcacaagtagcggagcatgtggtttaattcgaagcaacgcgaagaaccttacctaagcttgacatggggatgaaaagcaatgtaaagttgtaatgatactttcgggtatacatcccacacaggtggtgcatggttgtcgtcagctcgtgtcgtgagatgttgggttaagtcccgcaacgagcgcaacccctattgatagttgccagtgcgttaagataggcactctatcaagacagttatggataacataaaggaaggtggggatgacgtcaaatcatcatgccccttatgcttagggctacacacgtgctacaatggctgtaacaaagagaagcaaagtcgcaaggcggagcaaacctgaaaaaagcagtccaagttcggattgtgggctgaaactcgcccacatgaagtcggagttactagtaatcgcgaatgagaatgtcgcggtgaatgcgttcccgggtcttgtacacaccgcccgtcacaccatgggagctgagggtacccaaagtcagtgatctaacgtaagaagaagctgcctaaggtaaagttagtgactggggggaagtcgt

SEQ ID NO: 872 - DNA, 1356 bp, Eubacterium tenue
  modified_base (1343)..(1343): a, c, t, g, unknown or other
  modified_base (1349)..(1349): a, c, t, g, unknown or other
tcgagcgattctcttcggagaagagcggcggacgggtgagtaacgcgtgggtaacctgccctgtacacacggataacataccgaaaggtatgctaatacgagatgatatataattgttgcatgatttttatatcaaagcttttgcggtacaggatggacccgcgtctgattatctagttggtaaggtaacggcttaccagggcgacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggcggtctttcaagccagaagtgaaaggctacggctcaaccgtagtaagcttttggaactgtagacttgagtgcaggagaggagagtggaattcctagtgtagcggtgaaatgcgtagatattaggaggaacaccagtagcgaagcggctctctggactgtactgacgctgaggcacgaaagcgtggggagcaaacaggattagataccctggtagtccacgccgtaaacgatgagtactagtgtcgggggttacccccctcggtgccgcagctaacgcattaagtactccgcctgggaagtacgctcgcaagagtgaaactcacaggaattgacggggacccgcacaagtagcggatcatgtggtttaattcgaagcaacgcgaacaaccttacctaaacttgacatccccttgacctctcccgtatcggatatttcccgtcggggacagtggtgacaggtggtgcatgattgccgtcagctcgtgtcgtgagatgatgggttaagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaaaccgtgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttgggggcgcccgaagccggttagctancctttnggaagcg

SEQ ID NO: 873 - DNA, 1486 bp, Eubacterium tortuosum
  modified_base (1)..(1): a, c, t, g, unknown or other
  modified_base (123)..(123): a, c, t, g, unknown or other
  modified_base (347)..(347): a, c, t, g, unknown or other
  modified_base (970)..(970): a, c, t, g, unknown or other
  modified_base (1026)..(1026): a, c, t, g, unknown or other
  modified_base (1051)..(1051): a, c, t, g, unknown or other
ncaaatggagagtttgatcctggctcaggatgaacgctggcggcatgcctaatacatgcaagtcgaacgaagtcaattgaaagcttgcttttaaaagacttagtggcgaacgggtgagtaacncgtaggtaacctacccatgtaactgggataactgctggaaacggtagctaaaaccggataggtaagattgaggcatcttaatcttatgaaaaaagctttcgggctttgaacatggatggacctgcggcgcattagctagttggtgaggtaacggctcaccaaggcgatgatgcgtagccgacctgagagggtgaacggccacattgggactgagacacggcccnaactcctacgggaggcagcagtagggaattttcgtcaatggggggaaccctgaacgagcaatgccgcgtgagtgaagaaggtcttcggatcgtaaagctctgttgtaagtgaagaaagatgtatataggaaatgatatacaagtgacggtagcttaccagaaagccacggctaactacgtgccagcagccgcggtaatacgtaggtggcaagcgttatccggaatcattgggcgtaaagggtgcgtaggtggtacattaagtctgaagtaaaaggcatcagctcaactgatgttagctttggaaactgatgaactagagtgcagaagagggcaatggaattccatgtgtagcggtaaaatgcgtagatatatggaggaacaccagtggcgaaggcggttgcctggtctgtaactgacactgatgcacgaaagcgtggggagcaaataggattagataccctagtagtccacgccgtaaacgatgagaactaagtgttggggaaactcagtgctgcagttaacgcaataagttctccgcctggggagtatgcacgcaagtgtgaaactcaaaggaattgacgggggcccgcacaagcggtggagtatgtggtttaattcgaagnaacgcgaagaaccttaccaggccttgacatggatgtaaaagccctagagatagggnaataggtatacatcacacaggtggngcatggttgtcgtcagctcgtgtcgtgagatgttgggttaagtcccgcaacgagcgcaacccttgtcacatgttaccaatattaagttagggactcatgtgagactgccggtgacaaaccggaggaaggtggggatgacgtcaaatcatcatgccccttatggcctgggctacacacgtactacaatggcgactacaaagagcagcgaacctgcgaaggcaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggg

SEQ ID NO: 874 - DNA, 1378 bp, Eubacterium ventriosum
caccttggacagaatccttcgggaggaagaccattgtgactgagtggcggacgggtgagtaacgcgtgggtaacctgccttgtacagggggataacagttggaaacgactgctaataccgcataagcgcacagtaccgcatggtacggtgtgaaaaactccggtggtacaagatggacccgcgtctgattagctagttggtgaggtaacggcccaccaaggcgacgatcagtagccgacttgagagagtgatcggccacattgggactgagacacggcccaaactcctacgggaggcagcagtagggaatattgcacaatgggggaaaccctgatgcagcgacgccgcgtgaagaagaagtatttcggtatgtaaacttctatcagcaaggaagaaaatgacggtacttgactaagaagccccggctaaatacgtgccagcagccgcggtaatacgtatggggcaagcgttatccggatttactgggtgtaaagggagcgtaggcggcatggcaagtcagaagtgaaagcctggggctcaaccccggaattgcttttgaaactgtcaggctagagtgtcggaggggtaagcggaattcctagtgtagcggtgaaatgcgtagatattaggaggaacaccggtggcgaaggcggcttactggacgattactgacgctgaggctcgaaagcgtggggagcaaacaggattagataccctggtagtccacgccgtaaacgatgaatactacgtgtcgggggacaatagttcctcggtgccgaagcaaacgcattaagtattccacctggggagtacgttcgcaagaatgaaactcaaaggaattgacggggacccgcacaagcggtggagcatgtggtttaattcgaagcaacgcgaagaaccttacctgctcttgacatcccactgacaggtcagtaatgtgaccctttcctcggaacagtggagacaggtggtgcatggttgtcgtcagctcgtgtcgtgagatgttgggttaagtcccgcaacgagcgcaacccttgtctttagtagccagcagtccggctgggcactctagagagactgccagggataacctggaggaaggcggggatgacgtcaaatcatcatgccccttacgagcagggctacacacgtgctacaatggcgtaaacaaagggaagcgaccccgtgagggcaagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggatatgcccgaagtcagtgacccaaccgtaaggagg

SEQ ID NO: 875 - DNA, 1496 bp, Eubacterium xylanophilum
  modified_base (1)..(2): a, c, t, g, unknown or other
  modified_base (267)..(267): a, c, t, g, unknown or other
  modified_base (366)..(366): a, c, t, g, unknown or other
  modified_base (551)..(552): a, c, t, g, unknown or other
  modified_base (618)..(618): a, c, t, g, unknown or other
  modified_base (634)..(635): a, c, t, g, unknown or other
  modified_base (854)..(854): a, c, t, g, unknown or other
  modified_base (972)..(973): a, c, t, g, unknown or other
  modified_base (1201)..(1202): a, c, t, g, unknown or other
  modified_base (1391)..(1392): a, c, t, g, unknown or other
  modified_base (1409)..(1409): a, c, t, g, unknown or other
  modified_base (1448)..(1448): a, c, t, g, unknown or other
  modified_base (1456)..(1456): a, c, t, g, unknown or other
nnaatttgagagtttgatcctggctcaggatgaacgctggcggcgtgcttaacacatgcaagtcgaacgaagcatctctcccgaagattgaagtagcttgctacagattgattcatttgagatgacttagtggcggacgggtgagtaacgcgtgggtaacctgcctcatagagggggacaacagttggaaacgactgctaataccgcataacatgtgactgtcacatgacagacacatcaaagcttttgcgctatgagatggacccncgtctgattagctagttggtaaggtaacggcttaccaaggcgacgatcagtagccggcttgagagagtgaacggccacattgggactgagacacggccnagactcctacgggaggcagcagtggggaatattgcacaatgggggaaaccctgatgcagcgacgccgcgtgagtgaagaagtatttcggtatgtaaagctctatcagcagggaagataatgacggtacctgactaagaagccccggctaactacgtgccagcagccgcggtaatacgtagggggnnagcgttatccggatttactgggtgtaaagggagcgtaggtggcaaggcaagtcagatgtgaaatgncggggctcaaccccgnnactgcatttgaaactgtctagctagagtgcaggagaggtaagtggaattcctagtgtagcggtgaaatgcatagatattaggaggaacaccagtggcgaaggcggcttactggactgtaactgacactgaggctcgaaagcgtggggagcaaacaggattagataccctggtagtccacgccgtaaacgatgaatactaggtgtcggggcccacagggnttcggtgccgcagcaaacgcattaagtattccacctggggagtacgttcgcaagaatgaaactcaaaggaattgacggggacccgcacaagcggtggagcatgtggattaattcgaannaacgcgaagaaccttaccaagtcttgacatcctgctgaccgttccttagtcggaacttctcttcggagcagcagagacaggtggtgcatggttgtcgtcagctcgtgtcgtgagatgttgggttaagtcccgcaacgagcgcaacccttattcttagtagccagcattttggatgggcactctagggagactgccggagacaatccggaggaaggtggggatgacgtnnaatcatcatgccccttatgacttgggcttcacacgtgctacaatggtgactacaaagtgaagcgaccctgtgaaggtaagccaaccacaaaaaggtcatctcagttcggattgtagtctgcaactcgactacatgaagctggaatcgctagtaatcgcaaatcagcatgttgcggtgaatacgttcccnngtcttgtacacaccgcncgtcacaccatgggagttggatatgcccgaagccggtgncccaaccntaaggagggagccgtcgaaggtggagccaatgactggggt

SEQ ID NO: 876 - DNA, 1536 bp, Eubacterium yurii
ttttaattgagagtttgatcctggctcaggatgaacgctggcggcgtgcctaacacatgcaagtcgaacgaagtatatatatgaagtcttcggatggaatataaataacttagtggcggacgggtgagtaacgcgtaagtaatcaacctgtgacacacggataactgatagaaatgtcagctaatacgagatgaactgtttagattgggaaatggaaacagcaaagcgaaagcggtcacagacgagcttgcgtctgattagctagttggtggggtaagagcctaccaaggcgacgatcagtagccggcctgagagggtgaacggccacattggaactgagacacggtccaaactcctacgggaggcagcagtgggggatattgcacaatggggggaaccctgatgcagcaacgccgcgtgagtgaagaaggccctagggtcgtaaagctctgtcgtatgggaagaaacaaatgactgtaccatacaagaaagccccggctaactacgtgccagcagccgcggtaatacgtagggggcaagcgttatccggaattactgggcgtaaagggtgcgtaggcggctagttaagtcgaggttaaaaggcagtagctcaactactgttgggccttgaaactaattagcttgagtataggagaggaaagtggaattcccggtgtagcggtgaaatgcgtagatatcgggaggaataccggtggcgaaggcgactttctggactataactgacgctgaggcacgaaagcgtgggtagcaaacaggattagataccctggtagtccacgccgtaaacgatgaacactaggtgtcgggaggaatttcggtgccggcgcaaacgcaataagtgttccgcctggggagtacgttcgcaagaataaaactcaaaggaattgacggggacccgcacaagtagcggagcatgtggtttaattcgaagcaacgcgaagaaccttacctaagcttgacatggggatgaaaagcaatgtaaagttgtaatgatactttcgggtatacatcccacacaggtggtgcatggttgtcgtcagctcgtgtcgtgagatgttgggttaagtcccgcaacgagcgcaacccctattgatagttgccagtgcgttatggtaggcactctatcaagacagttatggataacataaaggaaggtggggatgacgtcaaatcatcatgccccttatgcttagggctacacacgtgctacaatggctgtaacaaagagaagcaaggtcgcaaggcggagcaaacctgaaaaaagcagtccaagttcggattgtgggctgaaactcgcccacatgaagtcggagttactagtaatcgcgaatcagaatgtcgcggtgaatgcgttcccgggtcttgtacacaccgcccgtcacaccatgggagctgagggtacccaaagtcagtgatctaacgaaagaagaagctgcctaaggtaaacttagtgactggggtgaagtcgtaacaaggtagccgtatcggaaggtgcggctggatcacctcctttct

SEQ ID NO: 877 - DNA, 1534 bp, Ewingella americana
agagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgaaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcgttaaggttaataaccttagcgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgggcttgacccgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcgagtaatgtcgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcct

SEQ ID NO: 878 - DNA, 1412 bp, Exiguobacterium acetylicum
  modified_base (1360)..(1362): a, c, t, g, unknown or other
  modified_base (1364)..(1365): a, c, t, g, unknown or other
gcgcaggaagctgacggaactcttcggagggaaggcagtggaatgagcggcggacgggtgagtaacacgtaaggaacctgcctcaaggattgggataactccgagaaatcggagctaataccggatagttcaacggaccgcatggtccgctgatgaaaggcgctccggcgtcaccttgagatggccttgcggtgcattagctagttggtggggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacacgtacgagagggaatgctcgtaccttgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccattgaccgcttgagagatcaagttttcccttcggggacaatggtgacaggtggtgcatggttgtcgtcagctcgtgtcgtgagatgttgggttaagtcccgcaacgagcgcaacccctatccttagttgccagcattcagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccataaagccgttcccagttcggattgcaggctgcaactcgcctgcatgaagtcggaatcgctagtaatcgcaggtcagcatactgcggtgaatacgttcccgggtcttgtacacaccgcccnnnannccacgagagtttgcaacacccgaagccggtgaggtaaccgcaaggag

SEQ ID NO: 879 - DNA, 1505 bp, Facklamia hominis
  modified_base (344)..(344): a, c, t, g, unknown or other
  modified_base (364)..(365): a, c, t, g, unknown or other
  modified_base (638)..(638): a, c, t, g, unknown or other
  modified_base (652)..(652): a, c, t, g, unknown or other
cgaacgctggcggcgtgcctaatacatgcaagtcgaacgaacggagctaggaactgaacccggcaaagttagtggcgcacgggtgagtaacacgtggagaacctacccttttgcgggggataaccattggaaacgatgactaataccgcatagaatcgcagatcgcatgatcaacgaaggaaagacggcttcggctgtcgcaaaaggatggctccgcggtgcattagctagatggtggggtaacggcctaccatggcaatgatgcatagccgacctgagagggtgatcggccacattgggactgagacacggcccaaactcctacgggaggcagcagtagggantcttccgcaatgggcgcaannctgacggagcaacgccgcgtgtgtgaagaaggtcttcggatcgtaaagcactgttgttagagaagaacgaccgctagagtaactgttagcggagtgacggtatctaaccagaaagccacggctaactacgtgccagcagccgcggtaatacgtaggtggcaagcgttgtccggatttattgggcgtaaagggagcgcaggcggtgacttaagtctgatgtgaaagcccacggctcaaccgtggagggtcattggaaactgggtcacttgagtncagaagaggaaagnggaattccatgtgtagcggtgaaatgcgtagatatatggaggaacaccagtggcgaaggcgactttctggtctgtaactgacgctgaggctcgaaagcgtggggagcaaacaggattagataccctggtagtccacgccgtaaacgatgagtgctaagtgttggagggtttccacccttcagtgctggagttaacgcaataagcactccgcctggggagtacggccgcaaggctgaaactcaaaggaattgacggggacccgcacaagcggtggagcatgtggtttaattcgaagcaacgcgaagaaccttaccaggtcttgacatctcttgcatagcctagagataggtgaagcccttcggggcaagaagacaggtggtgcatggttgtcgtcagctcgtgtcgtgagatgttgggttaagtcccgcaacgagcgcaacccttatcactagttgccagcattcagatggggactctagtgagactgccggtgacaaaccggaggaaggtggggatgacgtcaaatcatcatgccccttatgacctgggctacacacgtgctacaatggatggtacaacgagcagcgaactcgcaagggcaagcgaatctcttaaagccattctcagttcggattgttctctgcaactcgagaacatgaagccggaatcgctagtaatcgcggatcagcacgccgcggtgaatacgttcccgggtcttgtacacaccgcccgtcacaccacgagagtttgtaacacccgaagccggtggcctaactttatgaagccgtcgaaggtgggacagatgattggggtgaagtcgtaacaaggtagccgtatcggaaggtgcggctgg

SEQ ID NO: 880 - DNA, 1367 bp, Faecalibacterium prausnitzii
tcgaacgagcgagagagagcttgctttctcagagcgagtggcgaacgggtgagtaacgcgtgaggaacctgcctcaaagagggggacaacagttggaaacgactgctaataccgcataagcccacaggtcggcatcgagcagagggaaaaggagcaatccgctttgagatggcctcgcgtccgattagctagttggtgaggtaacggcccaccaaggcaacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttgaggaagataatgacggtactcaacaaggaagtgacggctaactacgtgccagcagccgcggtaaaacgtaggtcacaagcgttgtccggaattactgggtgtaaagggagcgcaggcgggaagacaagttggaagtgaaatctatgggctcaacccataaactgctttcaaaactgtttttcttgagtagtgcagaggtaggcggaattcccggtgtagcggtggaatgcgtagatatcgggaggaacaccagtggcgaaggcggcctactgggcaccaactgacgctgaggctcgaaagtgtgggtagcaaacaggattagataccctggtagtccacaccgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgacgcaacgcgaagaaccttaccaagtcttgacatcctgcgacgatgctggaaacagtattttccttcgggacgcagagacaggtggtgcatggttgtcgtcagctcgtgtcgtgagatgttgggttaagtcccgcaacgagcgcaacccttactgtcagttactacgcaagaggactctggcaggactgccgttgacaaaacggaggaaggtggggatgacgtcaaatcatcatgccctttatgacttgggctacacacgtactacaatggcgttaaacaaagagaagcaagaccgcgaggtggagcaaaactcagaaacaacgtcccagttcggactgcaggctgcaactcgcctgcacgaagtcggaattgctagtaatcgtggatcagcatgccacggtgaatacgttcccgggccttgtacacaccgcccgtcacaccatgagagccggggggacccgaagtcggtagtctaaccgcaaggagg

SEQ ID NO: 881 - DNA, 1530 bp, Filifactor alocis
agagtttgatcctggctcaggatgaacgctggcggcgtgcttaacacatgcaagtcgaacgaacgactattaacagaacctttcggggcgaagaatatagaagttagtggcggacgggtgcgtaacgcgtgggtaatctgcctttgtcaaaggaataactattcgaaagaatagctaaaaccgtataacatattaatagggcatcctaataatatcaaaactgaggtggacaaagatgagcccgcgtctgattagctagttggtgagataaaagcccaccaaggcaacgatcagtagccgacctgagagggtgaacggccacattggaactgagacacggtccaaactcctacgggaggcagcagtggggaatattgcacaatggggggaaccctgatgcagcaacgccgcgtgagtgaagaaggcattcgtgtcgtaaaactctgtagtaggggaagaaagaaatgacagtaccctaaaagaaagccccggctaactacgtgccagcagccgcggtaatacgtagggggcaagcgttatccggaataactgggcgtaaagggtgcgcaggtggtttaacaagttagtggtgaaaggcataggctcaaccaatgtaagccattaaaactgtttaacttgagtgcaggagaggaaagtggaattcctagtgtagcggcgaaatgcgtagatattaggaggaataccagtggcgaaggcgactttctggactgcaactgactctgaggcacgaaagcgtggggagcaaacaggattagataccctggtagtccacgccgtaaacgatgagtactaggtgtcgagtgaagaactcggtgccgaagttaacacattaagtactccgcctggggagtacgctcgcaagagtaaaactcaaaggaattgacggggacccgcacaagcagcggagcatgtggtttaattcgaagcaacgcgaagaaccttacctaaacttgacataccaatgacagccttttaatcgaggacttttaccttcgggtagacaatggatacaggtggtgcatggttgtcgtcagctcgtgtcgtgagatgttgggttaagtcccgcaacgagcgcaacccttgtcgatagttaccagcagtaagatggggactctatcgagacagctaaggacaacttagaggaaggtggggatgacgtcaaatcatcatgccccttatgtttagggctacacacgtgctacaatggtcattacagagagaagcgaaactgcgaagtcaagcaaacctcaaaaagatgatccaagttcggattgtaggctgaaactcgcctacatgaagttggagttgctagtaatcgcgaatcagaatgtcgcggtgaatgcgttcccgggtcttgtacacaccgcccgtcacaccatgggagtttggggggcccaaagtcagcgactcaaccgcaaggagagagctgcccaaggcaaaacaaatgactggggtgaagtcgtaacaaggtagccgtatcggaaggtgcggctggatcacctcctttct

SEQ ID NO: 882 - DNA, 1450 bp, Filifactor villosus
gatgaacgctggcggcgtgcttaacacatgcaagtcgaacgggcgaattatatcggaggtcttcgggccaaagagataataagctagtggcggacgggtgcgtaacgtgtgggtaatctgcctttgtcataggaataactgcttgaaaaagtagctaataccaaataacatatcgtataggcatctataagatatcaaagagaaatcggacaaagatgagcccgcatctgattagctggttggtagggtaaaagcctaccaaggcgacgatcagtagccggcctgagagggtgaacggccacattggaactgagacacggtccaaactcctacgggaggcagcagtggggaatattgcacaatggggggaaccctgatgcagcaacgccgcgtgagtgaagaaggctttcgagtcgtaaaactctgttgtaagggaagataatgacggtaccttaaaagaaagccccggctaactacgtgccagcagccgcggtaatacgtagggggcaagcgttatccggaataactgggcgtaaagggtgcgcaggtggtctgtcaagttagtggtgaaaggcataggctcaaccaatgtaagccattaaaactgacggacttgagtgcaggagaggaaagtggaattcctagtgtagcggtgaaatgcgtagatattaggaggaataccggtggcgaaggcgactttctggactgtaactgacactgaggcacgaaagcgtggggagcaaacaggattagataccctggtagtccacgccgtaaacgatgagtactaggtgtcgggaggaatctcggtgccgaagttaacacattaagtactccgcctggggagtacgctcgcaagagtaaaactcaaaggaattgacggggacccgcacaagcagcggagcatgtggtttaattcgaagcaacgcgaagaaccttacctaaacttgacataccgatgccgattcggtaatgcgaattttcctttcggggacattggatacaggtggtgcatggttgtcgtcagctcgtgtcgtgagatgttgggttaagtcccgcaacgagcgcaacccttgtcaatagttgccagcatataaggtggggactctattgagacagctaaggacaacttagaggaaggtggggatgacgtcaaatcatcatgccccttatgtttagggctacacacgtgctacaatggtcattacagagggaagcgagattgtgaaatggagcaaaccccaaaaagatgatctaagttcggattgtaggctgaaactcgcctacatgaagttggagttgctagtaatcgcaaatcaaaatgttgcggtgaatgcgttcccgggtcttgtacacaccgcccgtcacaccatgggagttcggggggcccaaagtcagtgagcaaaccgcgagggtgcagctgcctaaggcaaaacgaatgactggggtg

SEQ ID NO: 883 - DNA, 1525 bp, Finegoldia magna
ttaaattgagagtttgatcctggctcaggacgaacgctggcggcgtgcttaacacatgcaagtcgaacgggatttagtaaacagaagcttcggtggaagattactaatgagagtggcgaacgggtgagtaacgcgtgagcaacctgcctatgacagtgggatagcctcgggaaaccgggattaataccgcataaaatcgtagaaacacatgttttaacggtcaaagatttatcggtcatagatgggctcgcgtctgattagctagttggtgagataacagcccaccaaggcgacgatcagtagccggtctgagaggatgaacggccacattggaactgagacacggtccaaactcctacgggaggcagcagtggggaatattgcacaatgggggaaaccctgatgcagcgacgccgcgtgaacgaagaaggtattcgtatcgtaaagttctgtcctatgggaagataatgacagtaccatagaagaaagctccggctaaatacgtgccagcagccgcggtaatacgtatggagcgagcgttgtccggaattattgggcgtaaagggtacgcaggcggtttaataagtcgaatgttaaagatcggggctcaaccccgtaaagcattggaaactgataaacttgagtagtggagaggaaagtggaattcctagtgtagtggtgaaatacgtagatattaggaggaataccagtagcgaaggcgactttctggacacaaactgacgctgaggtacgaaagcgtggggagcaaacaggattagataccctggtagtccacgccgtaaacgatgaatgctaggtgttgggggtcaaacctcggtgccgaagttaacacattaagcattccgcctggggagtacgcacgcaagtgtgaaactcaaaggaattgacggggacccgcacaagcagcggagcatgtggtttaattcgatgcaacgcgaagaaccttaccagggcttgacatgtgggtgaaaggtatagagatatacccctctctttatgagacatccatacaggtggtgcatggttgtcgtcagctcgtgtcgtgagatgttgggttaagtcccgcaacgagcgcaacccctatacttagttaccagcgagtaatgtcggggactctaagtagactgccgatgacaaatcggaggaaggtggggatgacgtcaaatcatcatgccctttatgtcctgggctacacacgtgctacaatggttggtacagagggaagctatatagtgatataatgcaaaactccaaagccaatcccagttcggattgtaggctgcaactcgcctacatgaagtcggagttgctagtaatcgcggatcagaatgtcgcggtgaatgcgttcccgggtcttgtacacaccgcccgtcacaccatgggagttgataatacccgaagcctgtgacctaattgaggagcagtcgaaggtaggattgatgactggggtgaagtcgtaacaaggtagccgtatcggaaggtgcggctggatcacctcctttct

SEQ ID NO: 884 - DNA, 1291 bp, Flavobacteriaceae sp.
  C1
gatgaacgctagcgggaggcctaacacatgcaagctgagcgagcggcgtacgggtgcggaacacgtgtgcgacctgcctttatctgggggatagcctttcgaaaggaagattaatactccataatgaaaggcggatagagatgggcacgcgcaagattagctagttggtgaggtaacggctcaccaaggcaatgatctttagggggcctgagagggtgatcccccacactggtactgagacacggaccagactcctacgggaggcagcagtgaggaatattggtcaatgggtgcaagcctgaaccagccatcccgcgtgaaggacgactgcctatgggttgtaaacttcttttgtatagggatatgaaggtactatacgaataagcaccggctaactccgtgccagcagccgcggtaatacggagggtgcaagcgttatccggatttattgggtttaaagggtccgtaggcggacttataagtcagtggtgaaatcctgtcgcttaacgatagaactgccattgatactgtaagtcttgagtatatttgaggtagctggaataagtagtgtagcggtgaaatgcatagatattacttagaacaccaattgcgaaggcaggttaccaagataactgacgctgagggacgaaagcgtggggagcgaacaggattagataccctggtagtccacgccgtaaacgatgctaactcgtttttggagcttcagagaccaagcgaaagtgataagttagccacctggggagtacgctcgcaagagtgaaactcaaaggagttgacgggggcccgcacaagcggtggattatgtggtttaattcgatgatacgcgaggaaccttaccaagacttaaatggtcaaggtgctgcatggttgtcgtcagctcgtgccgtgaggtgttaggttaagtcctgcaacgagcgcaacccctgtcactagttgccatcatggggactctagtgagactgcctacgcaagtaggaggaaggtggggatgacgtcaaatcatcacggcccttacgtcttgggccacacacgtaatacaatggccggcagagggcagctacacagcgatgtgatgcaaatctcgccggtctcagttcggatggagtctgcaactcgactctagaagctggaatcgctagtaatcgcgcatcagccatggcgcggtgaatacgttcccgggccttgtacacaccgcccgtcaagccatggaagctgggggtacctgaagtcggtaccaggagctgcctagggtaaaactagtaactagggc

SEQ ID NO: 885 - DNA, 1480 bp, Flavobacterium sp.
  NF2-1
agagtttgatcctggctcaggatgaacgctagcggcaggcttaacacatgcaagtcgaggggtaggagaagcttgcttttctgagaccggcgcacgggtgcgtaacgcgtatgcaatctacctttcacagagggatagcccagagaaatttggattaataccttatagtattatagaatggcatcattttataattaaagatttatcggtgaaagatgagcatgcgtcccattagctagttggtatggtaacggcataccaaggcaacgatgggtaggggtcctgagagggagatcccccacactggtactgagacacggaccagactcctacgggaggcagcagtgaggaatattggacaatgggcgcaagcctgatccagccatgccgcgtgcaggatgacggtcctatggattgtaaactgcttttatacaggaagaaacccctctacgtgtagagacttgacggtactgtaagaataaggatcggctaactccgtgccagcagccgcggtaatacggaggatccaagcgttatccggaatcattgggtttaaagggtccgtaggcggtcagataagtcagtggtgaaagcccatcgctcaacggtggaacggccattgatactgtctgacttgaattattaggaagtaactagaatatgtagtgtagcggtgaaatgcttagagattacatggaataccaattgcgaaggcaggttactactaatatattgacgctgatggacgaaagcgtgggtagcgaacaggattagataccctggtagtccacgccgtaaacgatggatactagctgttgggcgcaagttcagtggctaagcgaaagtgataagtatcccacctggggagtacgaacgcaagtttgaaactcaaaggaattgacgggggcccgcacaagcggtggagcatgtggtttaattcgatgatacgcgaggaaccttaccaaggcttaaatgtagattgaccggtttggaaacagatctttcgcaagacaatttacaaggtgctgcatggttgtcgtcagctcgtgccgtgaggtgtcaggttaagtcctataacgagcgcaacccctgttgttagttgccagcgagtcatgtcgggaactctaacgagactgccagtgcaaactgtgaggaaggtggggatgacgtcaaatcatcacggcccttacgccttgggctacacacgtgctacaatggccggtacagagagcagccactgggtgaccaggagcgaatctataaaaccggtcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaactggtaactagggctaagtcgtaacaaggtagccgta

SEQ ID NO: 886 - DNA, 1465 bp, Flavonifractor plautii
cgctggcggcgtgcttaacacatgcaagtcgaacggggtgctcatgacggaggattcgtccaatggattgagttacctagtggcggacgggtgagtaacgcgtgaggaacctgccttggagaggggaataacactccgaaaggagtgctaataccgcatgaagcagttgggtcgcatggctctgactgccaaagatttatcgctctgagatggcctcgcgtctgattagctagtaggcggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcggggacgaaacaaatgacggtacccgacgaataagccacggctaactacgtgccagcagccgcggtaatacgtaggtggcaagcgttatccggatttactgggtgtaaagggcgtgtaggcgggattgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccactaacgaggcagagatgcgttaggtgcccttcggggaaagtggagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaggcaataccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtag

SEQ ID NO: 887 - DNA, 1467 bp, Flexispira rappini
  modified_base (1062)..(1062): a, c, t, g, unknown or other
  modified_base (1075)..(1075): a, c, t, g, unknown or other
agagtttgatcctggctcagagtgaacgctggcggcgtgcctaatacatgcaagtcgaacgatgaagcttctagcttgctagaagtggattagtggcgcacgggtgagtaatgcataggttatgtgccctttagtctgggatagccactggaaacggtgattaatactggatactccctacgggggaaaggtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttaggattgtaaactccttttgtaagagaagattatgacggtatcttacgaataagcgccggctaactccgtgccagcagccgcggtaatacggagggtgcaagcgttactcggaatcactgggcgtaaagagcgcgtaggcgggtggtcaagtcagatgtgaaatcctgtagcttaactacagaactgcatttgaaactgaccatctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgccctgcttgtcagggcagtaatgcagctaacgcattaagcattccgcctggggagtacggtcgcaagattaaaactcaaaggaatagacggggacccgcacaagcggtggagcatgtggtttaattcgaagctacgcgaagaactcttacctaggcttgacattgatagaatccgctagagatagtggagtgctggcttgccagagcttgaaaacaggtgctgcacggctgtcgtcagctcgtgtcgtgagatgttgggttaagtcccgcaacngagcgcaaccctnggtcccttagttgctagcagttcggctgagcactctaaggagactgccttcgtaaggaggaggaaggtgaggacgacgtcaagtcatcatggcccttacgcctagggctacacacgtgctacaatgggacatacaaaaagatgcaataccgcgaggtggagcaaatctctaaaatgtctctcagttcggattgtagtctgcaactcgactacataaagctggaatcgctagtaatcgtgaatcagcaatgtcacggtgaatacgttcccgggtcttgtactcaccgcccgtcacaccatgggagttgtattcgccttaagtcgggatactaaattggttaccgcccacggcggatgcagcgactggggtgaagtcgtaacaaggtaaccgta

SEQ ID NO: 888 - DNA, 1541 bp, Flexistipes sinusarabici
agagtttgatcctggctcagaacgaacgctggcggcgtgcttaacacatgcaagtcagggggaatcctcccttcggggaggtagtacaccggcgcacgggtgagtaacgcgtgagtgacctacccattagacctggataacccggcgaaagttgggctaagacaggatgtgttaatacacttcatggtgtattgataaaggcaggtttcggcttgtgctaatggatgggctcgcgtctgattagctagttggtaaggtaaaggcttaccaaggcgacgatcattaggcggcctgagagggtggtcgcccacactggaactgagacacggtccagactcctacgggaggcagcagtggggaattttgcgcaatgggcgagagcctgacgcagcgacgccgcgtggacgaggaaggccttcgggtcgtaaagtccttttttacgggaagaaagttattaacagtaactggttaatatttgacggtaccgtaagaataagccccggctaactccgtgccagcagccgcggtaatacggagggggcgagcgttgttcggaattactgggcgtaaagcgtacgtaggcggcgtggtaagtcggaggttaaaggctacggctcaaccgtagtagggcctttgatactatcatgctagagtgtcggagggggtagcggaattccctgtgtagcggtgaaatgcgtagatatagggaagaacaccagtagcgaaggcggctacctggccgatcactgacgctgaggtacgagagcgtgggtagcaaacaggattagataccctggtagtccacgctgtaaacgatggacgctaggtgttggaggaaccgaccccttcagtgccgaagccaacgcgttaagcgtcccgcctggggagtacgaccgcaaggttaaaactcaaaggaattgacgggggcccgcacaagcggtggagcacgtggtttaattcgatgctaaccgaagaaccttacctggtcttgacatcctccggagggactagagatagttctgtgcccgcctttggcgggagcggagagacaggtgctgcatggctgtcgtcagctcgtgccgtgaggtgttgggttaagtcccgcaacgagcgcaacccctattcatagttgccatcggtaaggccgggcactctatggatactgcccgtgataaacgggaggaaggtggggacgacgtcaagtcatcatggcctttatgaccagggctacacacgtgctacaatggtacgtacagagggcagcgaagccgcgaggtgtagcgaatccctaaaagcgtgccttagttcggattgtagtctgcaattcgactacatgaaggcggaatcgctagtaatcgcaggtcagcaaaactgcggtgaatacgttcccgggccttgtacacaccgcccgtcacaccacgggagttggttgtacctgaagccggtggcccaactgcggagggagccgtttatggtatgactggcaactggggtgaagtcgtaacaaggtagccgtaccggaaggtgtggctggatcacct

SEQ ID NO: 889 - DNA, 1530 bp, Francisella novicida
ttaaactgaagagtttgatcctggctcagattgaacgctggtggcatgcttaacacatgcaagtcgaacggtaacaggtcttcggatgctgacgagtggcggacgggtgagtaacgcgtaggaatctgcccatttgagggggataccagttggaaacgactgttaataccgcataatatctgtggattaaaggtggctttcgggctgtcgcagatggatgagcctgcgttggattagctagttggtggggtaagggcccaccaaggctacgatccatagctgatttgagaggatgatcagccacattgggactgagacacggcccaaactcctacgggaggcagcagtggggaatattggacaatgggggcaaccctgatccagcaatgccatgtgtgtgaagaaggccctagggttgtaaagcactttagttggggaggaaagcctcaaggttaatagccttgggggaggacgttacccaaagaataagcaccggctaactccgtgccagcagccgcggtaatacggggggtgcaagcgttaatcggaattactgggcgtaaagggtctgtaggtggtttgttaagtcagatgtgaaagcccagggctcaaccttggaactgcatttgatactggcaaactagagtacggtagaggaatggggaatttctggtgtagcggtgaaatgcgtagagatcagaaggaacaccaatggcgaaggcaacattctggaccgatactgacactgagggacgaaagcgtggggatcaaacaggattagataccctggtagtccacgctgtaaacgatgagtactagctgttggagtcggtgtaaaggctctagtggcgcagctaacgcgataagtactccgcctggggactacggccgcaaggctaaaactcaaaggaattgacggggacccgcacaagcggtggagcatgtggtttaattcgatgcaacgcgaagaaccttacctggtcttgacatcctgcgaactttctagagatagattggtgccttcgggaacgcagtgacaggtgctgcacggctgtcgtcagctcgtgttgtgaaatgttgggttaagtcccgcaacgagcgcaacccctattgatagttaccatcattaagttgggtactctattgagactgccgctgacaaggcggaggaaggtggggacgacgtcaagtcatcatggcccttacgaccagggctacacacgtgctacaatgggtattacagagggctgcgaaggtgcgagctggagcgaaactcaaaaaggtactcttagtccggattgcagtctgcaactcgactgcatgaagtcggaatcgctagtaatcgcaggtcagaatactgcggtgaatacgttcccgggtcttgtacacaccgcccgtcacaccatgggagtgggttgctccagaagtagatagcttaacgaatgggcgtttaccacggagtgattcatgactggggtgaagtcgtaacaaggtagccgtaggggaacctgcggctggatcacctcctta

SEQ ID NO: 890 - DNA, 1518 bp, Francisella philomiragia
agagtttgatcatggctcagattgaacgctggtggcatgcttaacacatgcaagtcgaacggtaacaggtcttcggatgctgacgagtggcggacgggtgagtaacgcgtaggaatctgcccatttgagggggataccagttggaaacgactgttaataccgcataatatctgtggattaaaggtggcttaggctgccgcagatggatgagcctgcgttggattagctagttggtggggtaagggcctaccaaggctacgatccatagctgatttgagaggatgatcagccacattgggactgagacacggcccaaactcctacgggaggcagcagtggggaatattggacaatgggggaaaccctgatccagcaatgccatgtgtgtgaagaaggctctagggttgtaaagcactttagttggggaggaaagcctataagttaatagcttgtaggaaggacgttacccaaagaataaggaccggctaactccgtgccagcagccgcggtaatacggggggtccgagcgttaatcggaattactgggcgtaaagggtctgtaggtggtttgttaagtcagatgtgaaagcccagggctcaaccttggaactgcatttgatactggcaaactagagtatggtagaggaatggggaatttctggtgtagcggtgaaatgcgtagagatcagaaggaacaccaatggcgaaggcaacattctggaccaatactgacactgagggacgaaagcgtggggatcaaacaggattagataccctggtagtccacgctgtaaacgatgagtactagctgttggattcggtgtaaaggatctagtggcgcagctaacgcgttaagtactccgcctggggactacggccgcaaggctaaaactcaaaggaattgacggggacccgcacaagcggtggagcatgtggtttaattcgatgcaacgcgaagaaccttacctggtcttgacatcctgcgaactttctagagatagattggtgccttcgggaacgcagtgacaggtgctgcacggctgtcgtcagctcgtgttgtgaaatgttgggttaagtcccgcaacgagcgcaacccctattgatagttaccatcattaagttgggtactctattgagactgccgctgacaaggcggaggaaggtggggacgacgtcaagtcatcatggcccttacgaccagggctacacacgtgctacaatgggtattacagagggctgcgaaggtgcgagctggagcgaaactcagaaaggtactcttagtccggattgcagtctgcaactcgactgcatgaagtcggaatcgctagtaatcgcaggtcagaatactgcggtgaatacgttcccgggtcttgtacacaccgcccgtcacaccatgggagtgggttgctccagaagtagatagcttaacgaatgggcgtttaccacggagtgattcatgactggggtgaagtcgtaacaaggtagccgtaggggaacctgcggctggatcacctcctt

SEQ ID NO: 891 - DNA, 1530 bp, Francisella tularensis
ttaaactgaagagtttgatcctggctcagattgaacgctggtggcatgcttaacacatgcaagtcgaacggtaacaggtcttaggatgctgacgagtggcggacgggtgagtaacgcgtaggaatctgcccatttgagggggataccagttggaaacgactgttaataccgcataatatctgtggattaaaggtggctttcgggctgtcgcagatggatgagcctgcgttggattagctagttggtggggtaagggcccaccaaggctacgatccatagctgatttgagaggatgatcagccacattgggactgagacacggcccaaactcctacgggaggcagcagtggggaatattggacaatgggggcaaccctgatccagcaatgccatgtgtgtgaagaaggccctagggttgtaaagcactttagttggggaggaaagcctcaaggttaatagccttgggggaggacgttacccaaagaataagcaccggctaactccgtgccagcagccgcggtaatacggggggtgcaagcgttaatcggaattactgggcgtaaagggtctgtaggtggtttgttaagtcagatgtgaaagcccagggctcaaccttggaactgcatttgatactggcaaactagagtacggtagaggaatggggaatttctggtgtagcggtgaaatgcgtagagatcagaaggaacaccaatggcgaaggcaacattctggaccgatactgacactgagggacgaaagcgtggggatcaaacaggattagataccctggtagtccacgctgtaaacgatgagtactagctgttggagtcggtgtaaaggctctagtggcgcagctaacgcgataagtactccgcctggggactacggccgcaaggctaaaactcaaaggaattgacggggacccgcacaagcggtggagcatgtggtttaattcgatgcaacgcgaagaaccttacctggtcttgacatcctgcgaactttctagagatagattggtgccttcgggaacgcagtgacaggtgctgcacggctgtcgtcagctcgtgttgtgaaatgttgggttaagtcccgcaacgagcgcaacccctattgatagttaccatcattaagttgggtactctattaagactgccgctgacaaggcggaggaaggtggggacgacgtcaagtcatcatggcccttacgaccagggctacacacgtgctacaatgggtattacagagggctgcgaaggtgcgagctggagcgaaactcaaaaaggtactcttagtccggattgcagtctgcaactcgactgcatgaagtcggaatcgctagtaatcgcaggtcagaatactgcggtgaatacgttcccgggtcttgtacacaccgcccgtcacaccatgggagtgggttgctccagaagtagatagcttaacgaatgggcgtttaccacggagtgattcatgactggggtgaagtcgtaacaaggtagccgtaggggaacctgcggctggatcacctcctta

SEQ ID NO: 892 - DNA, 1445 bp, Fulvimonas sp.
  NML 060897
gcctaacacatgcaagtcgaacggcagcacagtggagcttgctccatgggtggcgagtggcggacgggtgagtaaggcatcgggatctacccagacgtgggggataacgtagggaaacttacgctaataccgcatacgtcctacgggagaaagcgggggaccttcgggcctcgcgcggctggacgaaccgatgtgcgattagctagttggtggggtaaaggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccttcgggttgtaaagcacttttatcaggagcgaaatactgccggctaatacccggcggggctgacggtacctgaggaataagcaccggctaacttcgtgccagcagccgcggtaatacgaagggtgcaagcgttaatcggaattactgggcgtaaagcgtgcgtaggcggttctttaagtctgctgtgaaatccccgggctcaacctgggaatggcagtggatactggggagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcacgtaatggtgggaactctaaggagactgccggtgacaaaccggaggaaggtggggatgacgtcaagtcatcatggcccttacggccagggctacacacgtactacaatggtcggtacagagggttgcaataccgcgaggtggagccaatcccagaaagccgatcccagtccggatcggagtctgcaactcgactccgtgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgaccacggagtggttcatgactgg

SEQ ID NO: 893 - DNA, 1308 bp, Fusobacterium canifelinum
tggctcaggatgaacgctgacagaatgcttaacacatgcaagtctactgtggcggacgggtgagtaacgcgtaaagaacttgcctcacagctagggacaacatttggaaacgaatgctaatacctaatattgaaaggcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagtctgatccagcaattctgtgtgcacgatgaagtttttcggaatgtaaagtgctttcagttgggaagatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagactgacgctgaagcgcgaaagcgtgggtagcaaacaggattagataccctggtagtccacgccgtaaacgatgattactaggtgttggggcctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcgacaggtggtgcatggctgtcgtcagctcgtgtcgtgagatgttgggttaagtcccgcaacgagcgcaacccctttcgtatgttaccatcatggggactcatgcgatactgcctacgatgagtaggaggaaggtggggatgacgtcaagtcatcatgccccttatacgctgggctacacacgtgctacaatgggtagcagagagctgcaaagccgtgaggtggagctaatctcagctattcttagttcggatgtactctgcaactcgagtacagaagttggaatcgctagtaatcgcgaatcagcaatgtcgcggtgaatacgttctcgggtcttgtacacaccgcccgtcacaccacgagagttggttgcacctgaagtagcagcctagggatgctccgagggtgtgattagcgattggggtgaagtcgta

SEQ ID NO: 894 - DNA, 1294 bp, Fusobacterium sp.
  C1
gatgaacgctgacagaatgcttaacacatgcaagtcaacgagtggcggacgggtgagtaacgcgtaaagaacttgcctcacagctagggacaacatttagaaatgaatgctaatacctgatattgaaaggcactgtgagagagctttgcgtcccattagctagttggagaggtaacagctcaccaaggcgatgatgggtagccggcctgagagggtgaacggccacaaggggactgagacacggcccttactcctacgggaggcagcagtggggaatattggacaatggacgagagtctgatccagcaattccgtgtgcacgatgaagtttttcggaatgtaaagtgctttcagttgggaagatgacggtaccaacagaagaagtgacggctaaatacgtgccaacagccgcggtaatacgtatgtcacgagcgttatccggatttattgggcgtaaagcgcgcctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagactgacgctaaagcgcgagagcgtgggtagcaaacaggattagataccctggtagtccacgctgtaaacgatgattactaggtgttggggcctcagcgcccaagcaaacgcgataagtaatccgcctggggagtacgtacgcaagtatgaaactcaaaggaattgacgtggacccgcacaagcggtggagcatgtggtttaattcgacgcaacgcgaggaaccttaccagcgtttgacatcgacaggtggtgcatggctgtcgtcagctcgtgtcgtgagatgttgggttaagtcccgcaacgagcgcaacccctttcgtatgttaccatcatggggactcacgcgatactgcctacgatgagtaggaggaaggtggggatgacgtcaagtcattatgccccttatacgctgggctacacacgtgctacaatgggtagcagagagttgcaaagccgtgaggtgaagctaatctcagctatttttagttcggatgtactctgcaactcgagtacagaagttggaatcgctagtaatcgcgaatcagcaatgtcgcggtgaatacgttctcgggtcttgtacacaccgcccgtcacaccacgagagttggttgcacctgaagtagcggcctagggatgctccgagggtgtgattagcgattggggtg

SEQ ID NO: 895 - DNA, 1294 bp, Fusobacterium sp.
  C2
gatgaacgctgacagaatgcttaacacatgcaagtcaactggtggcggacgggtgagtaacgcgtaaagaacttgcctcacagctagggacaacatttagaaatgaatgctaatacctgatattgaaaggcactgtgagagagctttgcgtcccattagctagttggagaggtaacagctcaccaaggcgatgatgggtagccggcctgagagggtgaacggccacaaggggactgagacacggcccttactcctacgggaggcagcagtggggaatattggacaatggacgagagtctgatccagcaattctgtgtgcacgatgaagtttttcggaatgcaaagtgctttcagttgggaagatgacggtaccaacagaagaagtgacggctaaatacgtgccagcagccgcggtaatatgtatgtcacgagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagactgacgctaaagcgcgaaagcgtgggtagcaaacaggattagataccctggtagtccacgctgtaaacgatgattactaggtgttggggcctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcgacaggtggtgcatggctgtcgtcagctcgtgtcgtgagatgttgggttaagtcccgcaacgagcgcaacccctttcgtatgttaccatcatggggactcatgcgatactgcctacgatgagtaggaggaaggtggggatgacgtcaagtcatcatgccccttatacactgggctacacacgtgctacaatgggtagcagagggttgcaaagccgtgaggtgaagctaatctcggctattcttagttcggatgtactctgcaactcgagtacagaagttggaatcgctagtaatcgcgaatcagcaatgtcgcggtgaatacgttctcgggtcttgtacacaccgcccgtcacaccacgagagttggttgcacctgaagtagcagcctagggatgctccgagggtgtgattagcgattggggtg

SEQ ID NO: 896 - DNA, 1509 bp, Fusobacterium gonidiaformans
gaacgaagagtttgatcctggctcaggatgaacgctgacagaatgcttaacacatgcaagtcgactcgagtcttcggacttgggtggcggacgggtgagtaacgcgtaaagaacttgcctcatagtctgggacaacatctggaaacggatgctaataccggatattatgctttcttcgcatggaggaagtatgaaagctatatgcgctatgagagagctttgcgtcccattagctagttggtgaggtaacggcccaccaaggcgatgatgggtagccggcctgagagggtgaacggccacaaggggactgagacacggcccttactcctacgggaggcagcagtggggaatattggacaatggaccaaaagtctgatccagcaattctgtgtgcacgatgacgtttttcggaatgtaaagtgctttcagtcgggaagaagcaagtgacggtaccgacagaagaagcgacggctaaatacgtgccagcagccgcggtaatacgtatgtcgcaagcgttatccggatttattgggcgtaaagcgcgtctaggcggcaaggaaagtctgatgtgaaaatgcggggctcaactccgtattgcgttggaaactgccttactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgctgtaaacgatgattactaggtgttgggggtcaaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctacaaagagtgcagagatgcgcttgtgcttcttcggaagaatgtagtgacaggtggtgcatggctgtcgtcagctcgtgtcgtgagatgttgggttaagtcccgcaacgagcgcaacccctatcgtatgttaccagcctttagttggggactcatgcgatactgcctgcgacgagcaggaggaaggtggggatgacgtcaagtcatcatgccccttatacgctgggctacacacgtgctacaatgggtagtacagagagcggcgaacccgcgagggggagcaaatctcagaaaactattcttagttcggattgtactctgcaactcgagtacatgaagttggaatcgctagtaatcgcaaatcagcaatgttgcggtgaatacgttctcgggtcttgtacacaccgcccgtcacaccacgagagttggttgcacctgaagtagcaggcctaaccgtaaggaaggatgctccgagggtgtggttagcgattggggtgaagtcgtaacaaggtatccgtacgggaacgtgcggatggatcacctcctttct

SEQ ID NO: 897 - DNA, 1671 bp, Fusobacterium mortiferum
aaaaaagtattgacgaaaaatattatttgtggtaatatataccttgtccgcgagagagcggaactgatgaataaggacattagcaacagaatagagaaagacaattaatgcaaacacaacaataaattggtgtaaaacaatcagtaaattttactgagttatatagattgaacgaagagtttgatcctggctcaggatgaacgctgacagaatgcttaacacatgcaagtctacttgatccttcgggtgatggtggcggacgggtgagtaacgcgtaaagaacttgccctgcagtctgggacaacatttggaaacgaatgctaataccggatattatgtgagtttcgcatgaaattcatatgaaagctatatgcgctgcaggagagctttgcgtcctattagctagttggtgaggtaacggctcaccaaggcgatgataggtagccggcctgagagggtgaacggccacaaggggactgagacacggcccttactcctacgggaggcagcagtggggaatattggacaatggaccaaaagtctgatccagcaattctgtgtgcacgatgaagtttttcggaatgtaaagtgctttcagttgggacgaagtaagtgacggtaccaacagaagaagcgacggctaaatacgtgccagcagccgcggtaatacgtatgtcgcaagcgttatccggatttattgggcgtaaagcgcgtctaggcggtttggtaagtctgatgtgaaaatgcggggctcaactccgtattgcgttggaaactgtcaaactagagtactggagaggtgggcggaactacaagtgtagaggtgaaattcgtagatatttgtaggaatgccgatggggaagccagcccactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctaagaaattagcagagatgcttttgtgccccttcgggggaacttagtgacaggtggtgcatggctgtcgtcagctcgtgtcgtgagatgttgggttaagtcccgcaacgagcgcaacccctttcgtatgttgccatcattaagttgggcactcatgcgatactgcctgcgatgagcaggaggaaggtggggatgacgtcaagtcatcatgccccttatacgctgggctacacacgtgctacaatgggtagtacagagagtcgcaaacctgcgagggggagctaatctcagaaaactattctcagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtagcaggcctaaccgcaaggagggatgctccgagggtgtgattagcgattggggtgaagtcgtaacaaggtatccgtacgggaacgtgcggatggatcacct

SEQ ID NO: 898 - DNA, 1473 bp, Fusobacterium naviforme
tagagtttgatcatggctcaggatgaacgctggcggcgtgcttaacacatgcaagtcgaacgagagctacaggaggaagttttcggatggaatccggtagatcgagtggcggacgggtgagtaacgcgtggggaacctgcctcatacagggggataacagttggaaacgactgttaataccgcataagaccacagagtcgcatgactcaggggtaaaaactccggtggtatgagatggacccgcgttcgattagccagttggcggggtaacggcccaccaaagcgacgatcgatagccgatttgagagaatgaccggccacattgggactgagacacggcccaaactcctacgggaggcagcagtggggaatattgcacaatggggggaaccctgatgcagcgacgccgcgtgagtgaagaagtatttcggtatgtaaagctctatcagcagggaagaagatgacggtacctgagtaagaagccccggctaactacgtgccagcagccgcggtaatacgtagggggcaagcgttatccggatttactgggtgtaaagggagcgcagacggctatgcaagtctgaagtgaaagcccggggctcaaccccgggactgctttggaaactgtgyagctagagtgtcggagaggtagcagaattcccagtgtagcggtgaaatgcgtagatattgggaagaataccggtggcgaaggcgcttactggacgataactgacgttcaggctcgaaggcgtggggagcaaacaggattagataccctggtagtccacgcggtaaacgatgaatactaggtgttggcatccaaaggatgtcggtgccgtcgcaaacgcaataagtattccacctggggagtacgttcgcaagaatgaaactcaaaggaattgacggggacccgcacaagcagtggagcatgtggtttaattcgaagcaacgcgaagaaccttaccaagtcttgacatcccgatgaccggcctgtaaagaggccttctcttcggagcattggagacaggtggtgcatggttgtcgtcagctcgtgtcgtgagatgttgggttaagtcccgcaacgagcgcaacccctattgccagtagccagcaggtaaagctgggcactctggcgagactgcctgggataaccaggaggaaggtggggatgacgtcaaatcatcatgccccttatgatttgggcaacacacgtgctacaatggcgtaaacagagagaagcgaaggagcgatccggagcgaatctaaaaataacgtctcagttcggactgcagtctgcaactcgactgcacgaagctggaattgctagtaatcgcgaatcagcatgtcgcggtgaatacgttcccgggtcttgtacacaccgcccgtcacaccatgggagtcagcaacgcccgaagtcagtgacccaaccttagggagggagctgccgaaggcggggcggataactggggtgaa

SEQ ID NO: 899 - DNA, 1330 bp, Fusobacterium necrogenes
  modified_base (43)..(43): a, c, t, g, unknown or other
  modified_base (167)..(167): a, c, t, g, unknown or other
  modified_base (189)..(189): a, c, t, g, unknown or other
  modified_base (243)..(243): a, c, t, g, unknown or other
  modified_base (258)..(258): a, c, t, g, unknown or other
  modified_base (261)..(261): a, c, t, g, unknown or other
  modified_base (302)..(302): a, c, t, g, unknown or other
  modified_base (314)..(314): a, c, t, g, unknown or other
  modified_base (361)..(361): a, c, t, g, unknown or other
  modified_base (632)..(632): a, c, t, g, unknown or other
  modified_base (846)..(846): a, c, t, g, unknown or other
  modified_base (887)..(887): a, c, t, g, unknown or other
  modified_base (900)..(900): a, c, t, g, unknown or other
  modified_base (902)..(902): a, c, t, g, unknown or other
  modified_base (914)..(914): a, c, t, g, unknown or other
  modified_base (997)..(997): a, c, t, g, unknown or other
  modified_base (1074)..(1074): a, c, t, g, unknown or other
  modified_base (1091)..(1091): a, c, t, g, unknown or other
  modified_base (1139)..(1139): a, c, t, g, unknown or other
  modified_base (1172)..(1172): a, c, t, g, unknown or other
tggtggcggacgggtgagtaacgcgtaaagaacttgccctgcngtctgggacaacatttggaaacgaatgctaataccggatattatgtgagtttcgcatgaaattcatatgaaagctatatgcgctgtgggagagctttgcgtcctattagctagttggtgaggtnacggctcaccaaggcgatgatnggtagccggcctgagagggtgaacggccacaaggggactgagacacggcccttnctcctacgggaggcngcngtggggaatattggacaatggaccaaaagtctgatccagcnattctgtgtgcncgatgaagtttttcggaatgtaaagtgctttcagttgggacgaagtnagtgacggtaccaacagaagaagcgacggctaaatacgtgccagcagccgcggtaatacgtatgtcgcaagcgttatccggatttattgggcgtaaagcgcgtctaggcggtttggtaagtctgatgtgaaaatgcggggctcaactccgtattgcgttggaaactgccaaactagagtactggagaggtgggcggaactacaagtgtagaggtgaaattcgtagatatttgtaggaatgccgatggggaagccagcccactggacagatnctgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggaccgcacaagcggtggagcatgtggtttaattcgacgnaacgcgaggaaccttaccagcgtttgacatcctaagaaatnagcagagatgctntngtgcttcggggnaacttagtgacaggtggtgcatggctgtcgtcagctcgtgtcgtgagatgttgggttaagtcccgcaacgagcgcaacccctntcgtatgttgccatcattaagttgggcactcatgcgatactgcctgcgatgagcaggaggaaggtggggatgacgtnaagtcatcatgcccctnatacgctgggctacacacgtgctacaatgggtagtacagagagtcgcnaacctgcgagggggagctaatctcagaaaactnttctcagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtagcaggcctaaccg

SEQ ID NO: 900 - DNA, 1487 bp, Fusobacterium necrophorum
tttgatcctggctcaggatgaacgctgacagaatgcttaacacatgcaagtcgactcgagtcttcggacttgggtggcgcacgggtgagtaacgcgtaaagaacttgcctcttagaccgggacaacatctggaaacggatgctaataccggatattatggttttttcgcatggaggaatcatgaaagctagatgcgctaagagagagctttgcgtcccattagctagttggtgaggtaacggcccaccaaggcaatgatgggtagccggcctgagagggtgaacggccacaaggggactgagacacggcccttactcctacgggaggcagcagtggggaatattggacaatggaccacaagtctgatccagcaattctgtgtgcacgatgacgtttttcggaatgtaaagtgctttcagtcgggaagaagtcagtgacggtaccgacagaagaagcgacggctaaatacgtgccagcagccgcggtaatacgtatgtcgcaagcgttatccggatttattgggcgtaaagcgcgtctaggcggcaaggaaagtctgatgtgaaaatgcggagctcaactccgtatggcgttggaaactgccttactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgctgtaaacgatgattactaggtgttgggggtcaaacctcagcgcccaagctaacgcgataagtaatccgcctggggagtacgtacgcaagtatgaaactcaaaggaattgacggggaccgcacaagcggtggagcatgtggtttaattcgacgcaacgcgaggaaccttaccagcgtttgacatcctacgaacggagcagagatgcgccggtgccctttcgggggaacgtagtgacaggtggtgcatggctgtcgtcagctcgtgtcgtgagatgttgggttaagtcccgcaacgagcgcaacccctatcgtatgttaccatccttcagttggggactcatgcgatactgcctgcgacgagcaggaggaaggtggggatgacgtcaagtcatcatgccccttatacgctgggctacacacgtgctacaatgggtagtacagagagcggcaaacccgcgagggggagcaaatctcagaaaactattcttagttcggatggtactctgcaactcgagtacatgaagttggaatcgctagtaatcgcaaatcagcaatgttgcggtgaatacgttctcgggtcttgtacacaccgcccgtcacaccacgagagtgggttgcaactgaagtagcaggcctaaccttagggaaggatgctccgagggtgtggttagcgattggggtgaagtcgtaacaaggtatccgtacgggaacgtgcggctggatc

SEQ ID NO: 901 - DNA, 1523 bp, Fusobacterium nucleatum
ttgaacgaagagtttgatcctggctcaggatgaacgctgacagaatgcttaacacatgcaagtctacttgaatttgggttttttaacttcgatttgggtggcggacgggtgagtaacgcgtaaagaacttgcctcacagctagggacaacatttggaaacgaatgctaatacctgatattatgattatagggcatcctagaattatgaaagctatatgcgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacaatggaccgagagtctgatccagcaattctgtgtgcacgatgacgtttttcggaatgtaaagtgctttcagttgggaagaaaaaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagttgcaaagccgtgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgttccgagggtgtgattagcgattggggtgaagtcgtaacaaggtatccgtacgggaacgtgcggatggatcacctcctttct

SEQ ID NO: 902 - DNA, 1509 bp, Fusobacterium periodonticum
ttgaacgaagagtttgatcctggctcaggatgaacgctgacagaatgcttaacacatgcaagtctacttgaacttcggtttgggtggcggacgggtgagtaacgcgtaaagaacttgcctcacagttagggacaacatttggaaacgaatgctaatacctgatattatgattttagggcatcctaagattatgaaagctatatgcgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacaatggaccaagagtctgatccagcaattctgtgtgcacgatgacgtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgcatgactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtcaagtcatcatgccccttatacgctgggctacacacgtgctacaatgggtagtacagagagtcgcaaagccgcgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttct

SEQ ID NO: 903 - DNA, 1453 bp, Fusobacterium russii
  modified_base (1)..(2): a, c, t, g, unknown or other
  modified_base (298)..(298): a, c, t, g, unknown or other
  modified_base (321)..(322): a, c, t, g, unknown or other
  modified_base (511)..(511): a, c, t, g, unknown or other
  modified_base (885)..(885): a, c, t, g, unknown or other
  modified_base (893)..(893): a, c, t, g, unknown or other
  modified_base (895)..(895): a, c, t, g, unknown or other
  modified_base (901)..(901): a, c, t, g, unknown or other
  modified_base (926)..(928): a, c, t, g, unknown or other
  modified_base (1159)..(1160): a, c, t, g, unknown or other
  modified_base (1375)..(1375): a, c, t, g, unknown or other
  modified_base (1449)..(1450): a, c, t, g, unknown or other
nngaacgaagagtttgatcctggctcaggatgaacgctgacagaatgcttaacacatgcaagtcaacttgaacttcggtttgggtggcggacgggtgagtaacgcgtaaagaacttgcctcacagactgggacaacatttggaaacgaatgctaagaccggatattatgaattcattgcatgatgaagtcatgaaagctataagcgctgtgagagagctttgcgtcccattagctagttggagaggtaacggctcaccaaggcgatgatgggtagccggcctgagagggtgaacggcnacaaggggactgagacacggccnntactcctacgggaggcagcagtggggaatattggacaatggaccaagagtctgatccagcaattctgtgtgcacgatgaagtttttcggaatgtaaagtgctttcagttgggaagaagaaagtgacggtaccaacagaagaagcgacggctaaatacgtgccagcagccgcggtaatacgtatgctgcnagcgttatccggatttattgggcgtaaagcgcgtctaggcggctagataagtctgatgtgaaaatgcggggctcaactccgtattgcgttggaaactgtatagctagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattganggggaccngnacaagnggtggagcatgtggtttaattcgannnaacgcgaggaaccttaccagcgtttgacatcctactaagggctcagagatgagcttgtgctccttcgggagaaagtagagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtnnagtcatcatgccccttatacgctgggctacacacgtgctacaatgggtagaacagagagtggcgaagctgtgaagtggagcaaatctcagaaaactattcttagttcggattgtactctgcaactcgagtacatgaagttggaatcgctagtaatcgcaaatcagcaatgttgcggtgaatacgttctcgggtcttgtacacaccgcccgtcacnccacgagagttggttgcacctgaagtaacaggcctaaccgaaaggagggatgttccgagggtgtgattagcgannggg

SEQ ID NO: 904 - DNA, 1522 bp, Fusobacterium sp.
  11_3_2
ttgaacgaagagtttgatcctggctcaggatgaacgctgacagaatgcttaacacatgcaagtcaacttgaatttgggtttttaacttagatttgggtggcggacgggtgagtaacgcgtaaagaacttgcctcacagctagggacaacatttagaaatgaatgctaatacctgatattatgattttaaggcatcttagaattatgaaagctataagcactgtgagagagctttgcgtcccattagctagttggagaggtaacagctcaccaaggcgatgatgggtagccggcctgagagggtgaacggccacaaggggactgagacacggcccttactcctacgggaggcagcagtggggaatattggacaatggaccgagagtctgatccagcaattctgtgtgcacgatgaagtttttcggaatgtaaagtgctttcagttgggaagaaagaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgctgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagatagagatatttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagttgcaaagccgtgaggtgaagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttct

SEQ ID NO: 905 - DNA, 1496 bp, Fusobacterium sp.
  12_1B
agagtttgatcctggctcaggatgaacgctgacagaatgcttaacacatgcaagtctacttgatccttcgggtgaaggtggcggacgggtgagtaacgcgtaaagaacttgccttacagactgggacaacatttggaaacgaatgctaataccggatattatgattgggtcgcatgatctggttatgaaagctatatgcgctgtgagagagctttgcgtcccattagttagttggtgaggtaacggctcaccaagacgatgatgggtagccggcctgagagggtgaacggccacaaggggactgagacacggcccttactcctacgggaggcagcagtggggaatattggacaatggaccaaaagtctgatccagcaattctgtgtgcacgatgaagtttttcggaatgtaaagtgctttcagttgggaagaagtcagtgacggtaccaacagaagaagcgacggctaaatacgtgccagcagccgcggtaatacgtatgtcgcaagcgttatccggatttattgggcgtaaagcgcgtctaggcggcttagtaagtctgatgtgaaaatgcggggctcaaccccgtattgcgttggaaactgctaaactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcccaagaagttaacagagatgttttcgtgcctcttcggaggaacttggtgacaggtggtgcatggctgtcgtcagctcgtgtcgtgagatgttgggttaagtcccgcaacgagcgcaacccctttcgtatgttaccatcattaagttggggactcatgcgagactgcctgcgatgagcaggaggaaggtggggatgacgtcaagtcatcatgccccttatacgctgggctacacacgtgctacaatgggtagtacagagagctgcaaacctgcgagggtaagctaatctcataaaactattcttagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtaacaggcctaaccgtaaggagggatgttccgagggtgtgattagcgattggggtgaagtcgtaacaaggtatccgtacgggaacgtgcggatggatcacct

SEQ ID NO: 906 - DNA, 1509 bp, Fusobacterium sp.
  1_1_41FAA
ttgaacgaagagtttgatcctggctcaggatgaacgctgacagaatgcttaacacatgcaagtctacttgaacttcggtttgggtggcggacgggtgagtaacgcgtaaagaacttgcctcacagttagggacaacatttggaaacgaatgctaatacctgatattatgattttagggcatcctaagattatgaaagctatatgcgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacaatggaccaaaagtctgatccagcaattctgtgtgcacgatgacgtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgcatgactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcacttcggtgaaacctaaagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtcaagtcatcatgccccttatacgctgggctacacacgtgctacaatgggtagtacagagagtcgcaaagccgcgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgcaaggagggatgctccgagggtgtgattagcgattggggtgaagtcgtaacaaggtatccgtacgggaacgtgcggatggatcacctcctttct

SEQ ID NO: 907 - DNA, 1494 bp, Fusobacterium sp.
  2_1_31
agagtttgatcctggctcaggatgaacgctgacagaatgcttaacacatgcaagtctacttgaacttcggtttgggtggcggacgggtgagtaacgcgtaaagaacttgcctcacagttagggacaacatttggaaacgaatgctaatacctgatattatgattttagggcatcctaagattatgaaagctatatgcgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacaatggaccaaaagtctgatccagcaattctgtgtgcacgatgacgtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgcatgactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcacttcggtgaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagtacagagagtcgcaaagccgcgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacct

SEQ ID NO: 908 - DNA, 1522 bp, Fusobacterium sp.
  3_1_27
ttgaacgaagagtttgatcctggctcaggatgaacgctgacagaatgcttaacacatgcaagtcaacttgaatttgggtttttaacttaggtttgggtggcggacgggtgagtaacgcgtaaagaacttgcctcacagctagggacaacatttggaaacgaatgctaatacctaatattatgataatagggcatcctataattatgaaagctataagcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagagtctgatccagcaattctgtgtgcacgatgaagtttttcggaatgtaaagtgctttcagttgggaagaaaaaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggagtgagatagagatatttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagttgcaaagctgtgaagtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttct

SEQ ID NO: 909 - DNA, 1522 bp, Fusobacterium sp.
  3_1_33
ttgaacgaagagtttgatcctggctcaggatgaacgctgacagaatgcttaacacatgcaagtcaacttgaatttgggtttttaacttagatttgggtggcggacgggtgagtaacgcgtaaagaacttgcctcacagctagggacaacatttagaaatgaatgctaatacctgatattatgattttaaggcatcttagaattatgaaagctataagcactgtgagagagctttgcgtcccattagctagttggagaggtaacagctcaccaaggcgatgatgggtagccggcctgagagggtgaacggccacaaggggactgagacacggcccttactcctacgggaggcagcagtggggaatattggacaatggaccgagagtctgatccagcaattctgtgtgcacgatgaagtttttcggaatgtaaagtgctttcagttgggaagaaaaaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgctgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagatagagatatttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagttgcaaagccgtgaggtgaagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttct

SEQ ID NO: 910 - DNA, 1513 bp, Fusobacterium sp.
  3_1_36A2
agagtttgatcctggctcaggatgaacgctgacagaatgcttaacacatgcaagtcaacttgaatttgggtttttaacttaggtttgggtggcggacgggtgagtaacgcgtaaagaacttgcctcacagctagggacaacatttggaaacgaatgctaatacctaatattatgataatagggcatcctataattatgaaagctataagcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagagtctgatccagcaattctgtgtgcacgatgaagtttttcggaatgtaaagtgctttcagttgggaagaaagaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggatgagatagagatatttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagtcgcaaagctgtgaagtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttct

SEQ ID NO: 911 - DNA, 1369 bp, Fusobacterium sp.
  3_1_5R
ggaaacggatgctaataccggatattatgctttcttcgcatggaggaagtatgaaagctatatgcgctatgagagagctttgcgtcccattagctagttggtgaggtaacggcccaccaaggcgatgatgggtagccggcctgagagggtgaacggccacaaggggactgagacacggcccttactcctacgggaggcagcagtggggaatattggacaatggaccaaaagtctgatccagcaattctgtgtgcacgatgacgtttttcggaatgtaaagtgctttcagtcgggaagaagcaagtgacggtaccgacagaagaagcgacggctaaatacgtgccagcagccgcggtaatacgtatgtcgcaagcgttatccggatttattgggcgtaaagcgcgtctaggcggcaaggaaagtctgatgtgaaaatgcggggctcaactccgtattgcgttggaaactgccttactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgctgtaaacgatgattactaggtgttgggggtcaaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctacaaagagtgcagagatgcgcttgtgcttcttcggaagaatgtagtgacaggtggtgcatggctgtcgtcagctcgtgtcgtgagatgttgggttaagtcccgcaacgagcgcaacccctatcgtatgttaccagcctttagttggggactcatgcgatactgcctgcgacgagcaggaggaaggtggggatgacgtcaagtcatcatgccccttatacgctgggctacacacgtgctacaatgggtagtacagagagcggcgaacccgcgagggggagcaaatctcagaaaactattcttagttcggattgtactctgcaactcgagtacatgaagttggaatcgctagtaatcgcaaatcagcaatgttgcggtgaatacgttctcgggtcttgtacacaccgcccgtcacaccacgagagttggttgcacctgaagtagcaggcctaaccgtaaggaaggatgctccgagggtgtggttagcgattggggtgaagtcgtaacaaggtatccgtacgggaacgtgcggatggatcacctcctttct

SEQ ID NO: 912 - DNA, 1301 bp, Fusobacterium sp.
  AC18
tcaggatgaacgctgacagaatgcttaacacatgcaagtcaactggtggcggacgggtgagtaacgcgtaaagaacttgcctcacagatagggacaacatttggaaacgaatgctaatacctgatattgaaaggcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagtctgatccagcaattctgtgtgcacgatgaagtttttcggaatgtaaagtgctttcagttgggaagatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagactgacgctgaagcgcgaaagcgtgggtagcaaacaggattagataccctggtagtccacgccgtaaacgatgattactaggtgttggggcctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcgacaggtggtgcatggctgtcgtcagctcgtgtcgtgagatgttgggttaagtcccgcaacgagcgcaacccctttcgtatgttaccatcatggggactcatgcgatactgcctgcgatgagcaggaggaaggtggggatgacgtcaagtcatcatgccccttatacgctgggctacacacgtgctacaatgggtagcagagagtcgcaaagccgtgaggtggagctaatctcagctattcttagttcggatgtactctgcaactcgagtacagaagttggaatcgctagtaatcgcgaatcagcaatgtcgcggtgaatacgttctcgggtcttgtacacaccgcccgtcacaccacgagagttggttgcacctgaagtagcagcctagggatgctccgagggtgtgattagcgatggggtgaagtc

SEQ ID NO: 913 - DNA, 1300 bp, Fusobacterium sp.
  ACB2
tggctcaggatgaacgctgacagaatgcttaacacatgcaagtcaactggtggcggacgggtgagtaacgcgtaaagaacttgcctcacagctagggacaacatttagaaatgaatgctaatacctgatattgaaaggcactgtgagagagctttgcgtcccattagctagttggagaggtaacagctcaccaaggcgatgatgggtagccggcctgagagggtgaacggccacaaggggactgagacacggcccttactcctacgggaggcagcagtggggaatattggacaatggacgagagtctgatccagcaattctgtgtgcacgatgaagtttttcggaatgtaaagtgctttcagttgggaagatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagactgacgctaaagcgcgaaagcgtgggtagcaaacaggattagataccctggtagtccacgctgtaaacgatgattactaggtgttggggcctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcgacaggtggtgcatggctgtcgtcagctcgtgtcgtgagatgttgggttaagtcccgcaacgagcgcaacccctttcgtatgttaccatcatggggactcatgcgatactgcctacgatgagtaggaggaaggtggggatgacgtcaagtcatcatgccccttatacgctgggctacacacgtgctacaatgggtagcagagagttgcaaagccgtgaggtgaagctaatctcagctattcttagttcggatgtactctgcaactcgagtacagaagttggaatcgctagtaatcgcgaatcagcaatgtcgcggtgaatacgttctcgggtcttgtacacaccgcccgtcacaccacgagagttggttgcacctgaagtagcagcctagggatgctccgagggtgtgattagcgattgggg

SEQ ID NO: 914 - DNA, 1364 bp, Fusobacterium sp.
  AS2
ggctcaggatgaacgctgacagaatgcttaacacatgcaagtcaacttgaacttcggtttgggtggcggacgggtgagtaacgcgtaaagaacttgcctcacagatagggacaacatttggaaacgaatgctaatacctgatattatgattttagggcatcctaggattatgaaagctatatgcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagagtctgatccagcaattctgtgtgcacgatgaagtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatataagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtcaagtcatcatgccccttatacgctgggctacacacgtgctacaatgggtagtacagagagtcgcaaagccgtgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagt

SEQ ID NO: 915 - DNA, 1387 bp, Fusobacterium sp.
  CM1
gaacgctgacagaatgcttaacacatgcaagtcaacttgaatttgggtttttaacttagatttgggtggcggacgggtgagtaacgcgtaaagaacttgcctcacagctagggacaacatttagaaatgaatgctaatacctgatattatgattttaaggcatcttagaattatgaaagctatatgcactgtgagagagctttgcgtcccattagctagttggagaggtaacagctcaccaaggcgatgatgggtagccggcctgagagggtgaacggccacaaggggactgagacacggcccttactcctacgggaggcagcagtggggaatattggacaatggaccgagagtctgatccagcaattctgtgtgcacgatgaagtttttcggaatgtaaagtgctttcagttgggaagaaagaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgctgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagatagagatatttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagttgcaaagccgtgaggtgaagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagca

SEQ ID NO: 916 - DNA, 1385 bp, Fusobacterium sp.
  CM21
cgctgacagaatgcttaacacatgcaagtcaacttgaatttgggtttttaacttaggtttgggtggcggacgggtgagtaacgcgtaaagaacttgcctcacaggtagggacaacatttggaaacgaatgctaatacctaatattatgataatagggcatcctataattatgaaagctataagcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccgagagtctgatccagcaattctgtgtgcacgatgaagtttttcggaatgtaaagtgctttcagttgggaagaaacaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaagggtgggggatgacgtcaagtcatcatgccccttatacgctgggctacacacgtgctacaatgggtagaacagagagtcgcaaagctgtgaagtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagc

SEQ ID NO: 917 - DNA, 1210 bp, Fusobacterium sp.
  CM22
  modified_base (975)..(975): a, c, t, g, unknown or other
  modified_base (1090)..(1090): a, c, t, g, unknown or other
gtggcggacgggtgagtaacgcgtaaagaacttgcctcacagatagggacaacatttggaaacgaatgctaatacctgatattgaaaggcactgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagtctgatccagcaattctgtgtgcacgatgaagtttttcggaatgtaaagtgctttcagttgggaagatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagactgacgctgaagcgcgaaagcgtgggtagcaaacaggattagataccctggtagtccacgccgtaaacgatgattactaggtgttggggcctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcgacaggtggtgcatggctgtcgtcagctcgtgtcgtgagatgttgggttaagtcccgcaacgagcgcaacccctttcgtatgttaccatcatggggactcatgcgatactgcctgcgatgagcaggaggaaggtggggatgacgtcnagtcatcatgccccttatacgctgggctacacacgtgctacaatgggtagcagagagtcgcaaagccgtgaggtgaagctaatctcagctattcttagttcggatgtactctgcnactcgagtacagaagttggaatcgctagtaatcgcgaatcagcaatgtcgcggtgaatacgttctcgggtcttgtacacaccgcccgtcacaccacgagagttggttgcacctgaagtag

SEQ ID NO: 918 - DNA, 1496 bp, Fusobacterium sp.
  D12
agagtttgatcctggctcaggatgaacgctgacagaatgcttaacacatgcaagtcgactcgagtcttcggacttgggtggcgcacgggtgagtaacgcgtaaagaacttgcctcttagaccgggacaacatctggaaacggatgctaataccggatattatggttttttcgcatggaggaatcatgaaagctagatgcgctaagagagagctttgcgtcccattagctagttggtgaggtaacggcccaccaaggcaatgatgggtagccggcctgagagggtgaacggccacaaggggactgagacacggcccttactcctacgggaggcagcagtggggaatattggacaatggaccgcaagtctgatccagcaattctgtgtgcacgatgacgtttttcggaatgtaaagtgctttcagtcgggaagaagtcagtgacggtaccgacagaagaagcgacggctaaatacgtgccagcagccgcggtaatacgtatgtcgcaagcgttatccggatttattgggcgtaaagcgcgtctaggcggcaaggaaagtctgatgtgaaaatgcggagctcaactccgtatggcgttggaaactgccttactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgctgtaaacgatgattactaggtgttgggggtcaaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctacgaacggagcagagatgcgccggtgccctttcgggggaacgtagtgacaggtggtgcatggctgtcgtcagctcgtgtcgtgagatgttgggttaagtcccgcaacgagcgcaacccctatcgtatgttaccatccttcagttggggactcatgcgatactgcctgcgacgagcaggaggaaggtggggatgacgtcaagtcatcatgccccttatacgctgggctacacacgtgctacaatgggtagtacagagagcagcaaacccgcgagggggagcaaatctcagaaaactattcttagttcggattgtactctgcaactcgagtacatgaagttggaatcgctagtaatcgcaaatcagcaatgttgcggtgaatacgttctcgggtcttgtacacaccgcccgtcacaccacgagagttggttgcacctgaagtagcaggcctaaccttagggaaggatgctccgagggtgtggttagcgattggggtgaagtcgtaacaaggtatccgtacgggaacgtgcggatggatcacct

SEQ ID NO: 919 - DNA, 1362 bp, Fusobacterium sp.
  oral clone ASCF06
  modified_base (16)..(16): a, c, t, g, unknown or other
gagtttgattttggcncaggattaacgctgacgaatgcttaacacatgcaagtctactggtggcggacgggtgagtaacgcgtaaagaacttgcctcacagttagggacaacatttggaaacgaatgctaatacctgatattgaaaggcgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacactggacaaagtctgatccagcaattcgtgtgcacgatgacgtttttcggaatgtaaagtgctttcagttgggaagatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgcatgactagagtactggagaggtaagcggaactacaagtgtagaggtgaaattcgtagatatttgtaggaatgccgatggggaagccagcttactggacagactgacgctaaagcgcgaaagcgtgggtagcaaacaggattagataccctggtagtccacgccgtacacgatgattactaggtgttggggactcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcgacaggtggtgcatggctgtcgtcagctcgtgtcgtgagatgttgggttaagtcccgcaacgagcgcaaccccttttgtatgttaccatcagttggggactcatgcgatactgcctgcgatgagcaggaggaaggtggggatgacgtcaagtcatcatgccccttatacgctgggctacacacgtgctacaatgggtagcagagagtcgcaaagccgcgaggtggagctaatctcagctattcttagttcggatgtactctgcaactcgagtacagaagttggaatcgctagtaatcgcgaatcagcaatgtcgcggtgaatacgttctcgggtcttgtacacaccgcccgtcacaccacgagagttggttgcacctgaagtagcagcctagggatgctccgagggtgtgattagcgattggggtgaagtcgtaacaaggtatccgtacgggaacgtgcggctggaacacctcctt

SEQ ID NO: 920 - DNA, 1558 bp, Fusobacterium sp.
  oral clone ASCF11
  modified_base (623)..(623): a, c, t, g, unknown or other
  modified_base (852)..(852): a, c, t, g, unknown or other
  modified_base (884)..(884): a, c, t, g, unknown or other
  modified_base (947)..(947): a, c, t, g, unknown or other
gagagtttgattctggctcaggacgaacgctggcggcgtgcctaatacatgcaagtcgaacgagagcgaccggtgcttgcactgatcaatctagtggcgaacgggtgagtaacacgtgggtaacctgcccatcagagggggataacattcggaaacggatgctaaaaccgcataggttctttagtcgcatgactgaagaaggaaaagaggcttcggcttctgctgatggatggacccgcggtgcattagctagttggtgaggtaacggctcaccaaggcgatgatgcatagccgacctgagagggtgatcggccacattgggactgagacacggcccaaactcctacgggaggcagcagtagggaatcttccgcaatggacgcaagtctgacggagcaacgccgcgtgagtgaagaaggatttcggttcgtaaaactctgttgttagagaagaacagcgcatagagtaactgttatgcgtgtgacggtatctaaccagaaagccacggctaaatacgtgccagcagcccgcggtaataccgtatgtcacaagcgttatccggatttattgggcgtaaagcgcgtctaggtggttatgtaacgtctgatgtgaaaatgcagggnctcaactctgtattgcgttggaaactgcatgactagagtactggagaggtaagcggaactacaagtgtcagaggtgaaattcgtagatatttgtaggaatgccgatggggaaagcccagcttactggacagatactgacgctaaagcgcgaaagcgtgggtagcaaacaggattagataccctgggtagtccaccccgtaaacgatgattactaggtgttgggggtcgnacctcagcgcccaagctaacgcgataagtaanaccgcctggggagtacgtacgcaagtatgaaactcaaaggaattgaccggggacccgcacaangcggtggagcatgtggtttaattcgacgcaacgcgaggaaccttaccagcgtttgacatcttaggaatgagacagagatgtttcagtgtcacttcggtgaaacgctaaagaccaggtggtgcatggctggtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagtacagagagtcgcaaagccgtgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggctggatcacctccttc

SEQ ID NO: 921 - DNA, 1511 bp, Fusobacterium ulcerans
ttgaacgaagagtttgatcctggctcaggatgaacgctgacagaatgcttaacacatgcaagtctacttgatccttcgggtgaaggtggcggacgggtgagtaacgcgtaaagaacttgccttacagactgggacaacatttggaaacgaatgctaataccggatattatgattgggtcgcatgatctggttatgaaagctatatgcgctgtgagagagctttgcgtcccattagttagttggtgaggtaacggctcaccaagacgatgatgggtagccggcctgagagggtgaacggccacaaggggactgagacacggcccttactcctacgggaggcagcagtggggaatattggacaatggaccaaaagtctgatccagcaattctgtgtgcacgatgaagtttttcggaatgtaaagtgctttcagttgggaagaagtcagtgacggtaccaacagaagaagcgacggctaaatacgtgccagcagccgcggtaatacgtatgtcgcaagcgttatccggatttattgggcgtaaagcgcgtctaggcggcttagtaagtctgatgtgaaaatgcggggctcaaccccgtattgcgttggaaactgctaaactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcccaagaagttaacagagatgttttcgtgcctcttcggaggaacttggtgacaggtggtgcatggctgtcgtcagctcgtgtcgtgagatgttgggttaagtcccgcaacgagcgcaacccctttcgtatgttaccatcattaagttggggactcatgcgagactgcctgcgatgagcaggaggaaggtggggatgacgtcaagtcatcatgccccttatacgctgggctacacacgtgctacaatgggtagtacagagagctgcaaacctgcgagggtaagctaatctcataaaactattcttagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtaacaggcctaaccgtaaggagggatgttccgagggtgtgattagcgattggggtgaagtcgtaacaaggtatccgtacgggaacgtgcggatggatcacctcctttct

SEQ ID NO: 922 - DNA, 1503 bp, Fusobacterium varium
agagtttgatcctggctcaggatgaacgctgacagaatgcttaacacatgcaagtctacttgatccttcgggtgaaggtggcggacgggtgagtaacgcgtaaagaacttgccttacagactgggacaacatttggaaacgaatgctaataccggatattatgactgagtcgcatgatttggttatgaaagctatatgcgctgtgagagagctttgcgtcccattagttagttggtgaggtaacggctcaccaagacgatgatgggtagccggcctgagagggtgaacggccacaaggggactgagacacggcccttactcctacgggaggcagcagtggggaatattggacaatggaccaaaagtctgatccagcaattctgtgtgcacgatgaagtttttcggaatgtaaagtgctttcagttgggaagaagtcagtgacggtaccaacagaagaagcgacggctaaatacgtgccagcagccgcggtaatacgtatgtcgcaagcgttatccggatttattgggcgtaaagcgcgtctaggcggtttagtaagtctgatgtgaaaatgcggggctcaaccccgtattgcgttggaaactgctaaactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcccaagaagttaacagagatgttttcgtgcctcttcggaggaacttggtgacaggtggtgcatggctgtcgtcagctcgtgtcgtgagatgttgggttaagtcccgcaacgagcgcaacccctttcgtatgttaccatcattaagttggggactcatgcgagactgcctgcgatgagcaggaggaaggtggggatgacgtcaagtcatcatgccccttatacgctgggctacacacgtgctacaatgggtagtacagagagctgcaaacctgcgagggtaagctaatctcataaaactattcttagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtaacaggcctaaccgtaaggagggatgttccgagggtgtgattagcgattggggtgaagtcgtaacaaggtatccgtacgggaacgtgcggatggatcacctcctttct

SEQ ID NO: 923 - DNA, 1535 bp, Gardnerella vaginalis
ttttcgtggagggttcgattctggctcaggatgaacgctggcggcgtgcttaacacatgcaagtcgaacgggatctgaccagcttgctggttggtgagagtggcgaacgggtgagtaatgcgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagctttcgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtctgcgccgggtacgggcgggctagagtgcagtaggggagactggaattcccggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgtcgactgcagagatgtggtttcccttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccggtacaacgggatgcgacatggtgacatggagcggatcccttaaaaccggtctcagttcggatcgtagtctgcaactcgactacgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttttgggatggagccgtctaaggtgaggctcgtgattgggactaagtcgtaacaaggtagccgtaccggaaggtgcggctggatcacctcctttctacgg

SEQ ID NO: 924 - DNA, 1557 bp, Gemella haemolysans
ttggagagtttgatcctggctcaggacgaacgctggcggcgtgcctaatacatgcaagtcgagcgaggtttttctggtgcttgcaccggaaaaacttagcggcgaacgggtgagtaacacgtaaagaacctgcctcatagactgggacaactattggaaacgatagctaataccggataacagcattaactgcatggttgatgtttaaaagttggttttgctaacactatgagatggctttgcggtgcattagctagttggtggggtaaaggcctaccaaggcgacgatgcatagccgacctgagagggtagatcggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaatgattgtgtagtaactatacacagtagagacggtacctaaccagaaagccacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgtaactgacactgaggcgcgaaagcgtggggagcaaacaggattagataccctggtagtccacgccgtaaacgatgagtgctaagtgttggtctcataagagatcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaagtcttgacatactgtgaggacacaagagattgtgttgttctgacctttggttagacacagatacaggtggtgcatggttgtcgtcagctcgtgtcgtgagatgttgggttaagtcccgcaacgagcgcaacccttatatctagttgccagcagtaagatggggactctagatagactgccagtgataaactggaggaaggtggggatgacgtcaaatcatcatgccccttatgacttgggctacacacgtgctacaatggataggaacaaagagaagcgagctcgcgagagtaagcaaacctcacaaaactattctcagttcggattgtagtctgcaactcgactacatgaagctggaatcgctagtaatcgcgaatcagaatgtcgcggtgaatacgttcccgggtcttgtacacaccgcccgtcacaccacgagagtttgtaacacccgaagacggtggcctaaccttttaggagggagccggtcacggtgggacagatgattggggtgaagtcgtaacaaggtagccgtatcggaaggtgcggctggatcacctcctttct

SEQ ID NO: 925 - DNA, 1560 bp, Gemella morbillorum
tttatttggagagtttgatcctggctcaggacgaacgctggcggcgtgcctaatacatgcaagtcgagcgaagtttttctggtgcttgcactagaaaaacttagcggcgaacgggtgagtaacacgtaaagaacctgcctcatagactgggacaactattggaaacgatagctaataccggataacagtatttctcgcatgagagatatttaaaagttggttatgctaacactatgagatggctttgcggtgcattagctagttggtgggtaaaggcctaccaaggcgacgatgcatagccgacctgagagggtgatcggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaatggatatgtagtaactatacatgtaagagacggtacctaaccagaaagccacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgtaactgacactgaggcgcgaaagcgtggggagcaaacaggattagataccctggtagtccacgccgtaaacgatgagtgctaagtgttggtctcataagagatcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaagtcttgacatactgtgaggacacaagagattgtgttgttctgacctatggttagacacagatacaggtggtgcatggttgtcgtcagctcgtgtcgtgagatgttgggttaagtcccgcaacgagcgcaacccttatatctagttgccagcagtaagatggggactctagatagactgccagtgataaactggaggaaggtggggatgacgtcaaatcatcatgccccttatgacttgggctacacacgtgctacaatggataggaacaaagagaagcgagctcgcgagagtcagccaacctcataaaactattctcagttcggattgtagtctgcaactcgactacatgaagctggaatcgctagtaatcgcgaatcagaatgtcgcggtgaatacgttcccgggtcttgtacacaccgcccgtcacaccacgagagtttgtaacacccgaagacggtggcctaacctttaaggagggagccggtcacggtgggacagatgattggggtgaagtcgtaacaaggtagccgtatcggaaggtgcggctggatcacctcctttct

SEQ ID NO: 926 - DNA, 1560 bp, Gemella morbillorum; identical to SEQ ID NO: 925

SEQ ID NO: 927 - DNA, 1557 bp, Gemella sanguinis
ttggagagtttgatcctggctcaggacgaacgctggcggcgtgcctaatacatgcaagtcgagcgaagtttttctggtgcttgcactagaaaaacttagcggcgaacgggtgagtaacacgtaaagaacctgcctcatagacggggacaactattggaaacgatagctaataccggataacagcataaatcgcatgatatatgtttaaaagttggtttcggctaacactatgagatggctttgcggtgcattagctagttggtggggtaaaggcctaccaaggcgacgatgcatagccgacctgagagggtgatcggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaatgattgtgtagtaactatacacagtagagacggtacctaaccagaaagccacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgtaactgacactgaggcgcgaaagcgtggggagcaaacaggattagataccctggtagtccacgccgtaaacgatgagtgctaagtgttggtctcataagagatcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaagtcttgacatactgtgaggacacaagagattgtgttgttctgacctttggttagacacagatacaggtggtgcatggttgtcgtcagctcgtgtcgtgagatgttgggttaagtcccgcaacgagcgcaacccctatgtctagttgccagcagtaagatggggactctagacagactgccagtgataaactggaggaaggcggggatgacgtcaaatcatcatgccccttatgacttgggctacacacgtgctacaatggataggaacaaagagaagctaactcgcgagagcaagcaaacctcataaaactattctcagttcggattgtagtctgcaactcgactacatgaagctggaatcgctagtaatcgcgaatcagaatgtcgcggtgaatacgttcccgggtcttgtacacaccgcccgtcacaccacgagagtttgtaacacccgaagacggtggcctaacctttaaggagggagccggtcacggtgggacagatgattggggtgaagtcgtaacaaggtagccgtatcggaaggtgcggctggatcacctcctttct

SEQ ID NO: 928 - DNA, 1403 bp, Gemella sp.
  WAL 1945J
cgaactttaagagtgcttgcacacttaaagttagcggcgaacgggtgagtaacacgtaaagaacctaccttatagacagggacaactattggaaacgatagctaatacctgataagaaagaaactcgcatgagagaagttcgaaagtcggagcaatctgacactataagatggctttgcggtgcattagctagttggtagggtaaaagcctaccaaggcgacgatgcatagccgacctgagagggtgatcggccacattgggactgagacacggcccagactcctacgggaggcagcagtagggaatcttccgcaatggacgcaagtctgacggagcaacgccgcgtgagtgaagaaggatttcggttcgtaaaactctgttgttagggaagaaaaaatgtataataactatatacaaaagagacggtacctaaccagaaagccacggctaactacgtgccagcagccgcggtaatacgtaggtggcaagcgttgtccggaattattgggcgtaaagcgcgcgcaggtggtttagaaagtctgatgtgaaagcccacggctcaaccgtggagggtcattggaaactaataaacttgagtgcaggagagaaaagtggaattcctagtgtagcggtgaaatgcgtagagattaggaggaacaccggtggcgaaagcggctttttggcctgcaactgacactgaggcgcgaaagcgtggggagcaaacaggattagataccctggtagtccacgccgtaaacgatgagtgctaagtgttggagtcaaaagacttcagtgctgccagcaaacgcattaagcactccgcctggggagtacgatcgcaagattgaaactcaaaggaattgacggggacccgcacaagcggtggagtatgtggtttaattcgaagcaacgcgaagaaccttaccaagtcttgacatacagtgaagatataagaaattatattgttttaatgtttacattaaacactgatacaggtggtgcatggttgtcgtcagctcgtgtcgtgagatgttgggttaagtcccgcaacgagcgcaacccttatatctagttaccagcagtaagatggggactctagatagactgccagtgacaaactggaggaaggtggggatgacgtcaaatcatcatgccccttatgacttgggctacacacgtactacaatggataggaacaaagagaagcgacctcgcaagagcaagccaacctcagaaaactattctcagttcggattgtaggctgcaactcgcctacatgaagctggaatcgctagtaatcgcgaatcagaatgtcgcggtgaatacgttcccgggtcttgtacacaccgcccgtcacaccacgagagtttgtaacacctgaagacggtggcctaaccgtaag

SEQ ID NO: 929 - DNA, 1364 bp, Gemella sp.
  oral clone ASCE02
  modified_base (221)..(221): a, c, t, g, unknown or other
  modified_base (729)..(729): a, c, t, g, unknown or other
gagtttgatcttggctcaggacgaacgctggcggcgtgcctaatacatgcaagtcgagcgagcggcgaacaggtgagtaacacgtaaagaaagtgcctcatagactgggacaactattggaaacgatagctaataccggataacaaaagacactatgagatggctttgcggtgcattagctagttggtggggtaaaggcttaccaaggcgacgatgcatanccgacctgagagggtgatcggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaagacggtacctaaccagaaagtcacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgactgacactgaggcgcgaaagcgtggggagcaaacaggattagataccctggtagtccacgccgtaaacgatgagtgcntagtgttggtcgatcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaagtcttgacatatacaggtggtgcatggttgtcgtcagctcgtgtcgtgagatgttgggttaagtcccgcaacgagcgcaacccttatatctagttgccagcatggggactctagatagactgccagtgataaactggaggaaggtggggatgacgtcaaatcatcatgccccttatgacttgggctacacacgtgctacaatggatagcaaagagaagcgagctcgcgagagtaagcaaacctcacctattctcagttcggatgtagtctgcaactcgactacagaagctggaatcgctagtaatcgcgaatcagaatgtcgcggtgaatacgttcccgggtcttgtacacaccgcccgtcacaccacgagagtttgtaacacccgaagacggtgcctagggagccggtcacggtgggacagatgattggggtgaagtcgtaacaaggtagccgtatcggaaggtgcggctggaacacctcctt

SEQ ID NO: 930 - DNA, 1362 bp, Gemella sp.
  oral clone ASCF04
  modified_base (823)..(823): a, c, t, g, unknown or other
  modified_base (837)..(837): a, c, t, g, unknown or other
  modified_base (845)..(845): a, c, t, g, unknown or other
  modified_base (849)..(849): a, c, t, g, unknown or other
  modified_base (1001)..(1001): a, c, t, g, unknown or other
  modified_base (1059)..(1059): a, c, t, g, unknown or other
gagtttgattatggctcaggacgaacgctggcggcgtgcctaatacatgcaagtcgagcgagcggcgaacgggtgagtaacacgtaaagaacctgcctcatagactgggacaactattggaaacgatagctaataccggataacaaaagacactatgagatggctttgcggtgcattagctagttggtggggtaaaggcctaccaaggcgacgatgcatagccgacctgagagggtgatcggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaagacggtacctaaccagaaagccacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggcttgttggcctgactgacactgaggcgcgaaagcgtggggagcaaacaggattagataccctggtagtccacgccgtaaacgatgagtgctaagtgttggtcgatcagtgctgcagctaacgcattaagcactccgcctggggagtacgaccgccaggttgaaactgaaaggaattcccgggganccgcacgcggtggngcatgtgntttnattcgaagcaacgcgaagaaccttaccaagtcttgacatatgcaggtggtgcatggttgtcgtcagctcgtgtcgtgagatgttgggttaagtcccgcaacgagcgcaacccttatatctagttgccagcatggggactctagatagactgncagtgataaactggaggaaggtggggatgacgtcaaatcatcatgccccttatgactngggctacacacgtgctacaatggatagcaaagagaagcgagctcgcgagagtaagcaaacctcacctattctcagttcggatgtagtctgcaactcgactacagaagctggaatcgctagtaatcgcgaatcagaatgtcgcggtgaatacgttcccgggtcttgtacacaccgcccgtcacaccacgagagtttgtaacacccgaagacggtgcctagggatccggtcacggtgggacagatgattggggtgaagtcgtaacaaggtagccgtatcggaaggtgcggctggaacacctcctt

SEQ ID NO: 931 - DNA, 1340 bp, Gemella sp.
  oral clone ASCF12
  modified_base (140)..(140): a, c, t, g, unknown or other
  modified_base (161)..(161): a, c, t, g, unknown or other
  modified_base (331)..(331): a, c, t, g, unknown or other
  modified_base (693)..(693): a, c, t, g, unknown or other
acgctggcggcgtgcctaatacatgcaagtcgagcgagcggcgaacgggtgagtaacacgtaaagaacctgcctcatagacggggacaactattggaaacgatagctaataccggataacaaaagacactatgagatggntttgcggtgcattagctagtnggtggggtaaaggcctaccaaggcgacgatgcatagccgacctgagagggtgatcggccacactgggactgagacacggcccagactcctacgggaggcagcagtagggaatcttccgcaatgggcgaaagcctgacggagccacgccgtgtgagtgaagaaggatttcnggtcgtaaagctctgttgttagggaagaagacggtacctaaccagaaagccacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgactgacactgaggcgcgaaagcgtggggagcaaacaggattagataccctggtagtccacgccgtanacgatgagtgctaagtgttggtcgatcagtgctgcagctaacgcattaagcactccgcctggggagtacgaccggaaggttgaaactcaaaggaattgacggggacccgcacaagcggtggagcatgtggtttaattcgaagcaacgcgaagaaccttaccaagtcttgacatatacaggtggtgcatggttgtcgtcagctcgtgtcgtgagatgttgggttaagtcccgcaacgagcgcaacccctatgtctagttgccagcatggggactctagacagactgccagtgataaactggaggaaggcggggatgacgtcaaatcatcatgccccttatgacttgggctacacacgtgctacaatggatagcaaagagaagctaactcgcgagagcaagcaaacctcatctattctcagttcggatgtagtctgcaactcgactacagaagctggaatcgctagtaatcgcgaatcagaatgtcgcggtgaatacgttcccgggtcttgtacacaccgcccgtcacaccacgagagtttgtaacacccgaagacggtgcctagggagccggtcacggtgggacagacgattggggtgaagtcgtaacaaggtagccgtatcggaaggtgcggctggaacacctcctt

SEQ ID NO: 932 - DNA, 1367 bp, Gemmiger formicilis
  modified_base (10)..(12): a, c, t, g, unknown or other
  modified_base (1359)..(1360): a, c, t, g, unknown or other
aacggagtcnnngaggagcttgcttttcttgatttagtggcgaacgggtgagtaacgcgtgagtaacctgccctggagtgggggacaacagttggaaacgactgctaataccgcataagcccacggtgccgcatggcactgagggaaaaggatttattcgcttcaggatggactcgcgtccaattagctagttggtgaggtaacggcccaccaaggcgacgattggtagccggactgagaggttgaacggccacattgggactgagacacggcccagactcctacgggaggcagcagtgggggatattgcacaatgggggaaaccctgatgcagcgacgccgcgtggaggaagaaggttttcggattgtaaactcctgtcgttagggacgataatgacggtacctaacaagaaagcaccggctaactacgtgccagcagccgcggtaaaacgtagggtgcaagcgttgtccggaattactgggtgtaaagggagcgcaggcggaccggcaagttggaagtgaaatccatgggctcaacccgtgaattgctttcaaaactgctggccttgagtagtgcagaggtaggtggaattcccggtgtagcggtggaatgcgtagatatcgggaggaacaccagtggcgaaggcgacctactgggcaccaactgacgctgaggctcgaaagcatgggtagcaaacaggattagataccctggtagtccatgccgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccgatgcatagtgcagagatgcatgaagtccttcgggacatcgagacagatggtgcatggttgtcgtcagctcgtgtcgtgagatgttgggttaagtcccgcaacgagcgcaacccttattgccagttactacgcaagaggactctggcgagactgccgttgacaaaacggaggaaggtggggatgacgtcaaatcatcatgccctttatgacctgggctacacacgtactacaatggcgtttaacaaagagaagcaagaccgcgaggtggagcaaaactcagaaacaacgtctcagttcagattgcaggctgcaactcgcctgcatgaagtcggaattgctagtaatcgcggatcagcatgccgcggtgaatacgttcccgggccttgtacacaccgcccgtcacaccatgagagccggggggacccgaagtcggtagtctaaccnnaaggagg

SEQ ID NO: 933 - DNA, 1553 bp, Geobacillus kaustophilus
gagagtttgatcctggctcaggacgaacgctggcggcgtgcctaatacatgcaagtcgagcggaccaaatcggagcttgctctgatttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcgggggacagggtgacaggtggtgcatggttgtcgtcagctcgtgtcgtgagatgttgggttaagtcccgcaacgagcgcaaccctcgcctctagttgccagcacgaaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccttacgggagccagccgccgaaggtggggcaagtgattggggtgaagtcgtaacaaggtagccgtaccggaaggtgcggctggatcacctcctttct

SEQ ID NO: 934 - DNA, 1517 bp, Geobacillus sp.
  E263
agtttgatcctggctcaggacgaacgctggcggcgtgcctaatacatgcaagtcgagcggaccaaatcggagcttgctctgatttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagacccctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcacgaaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgcaagggagccagccgccgaaggtggggcaagtgattggggtgaagtcgtaacaaggtaacc

SEQ ID NO: 935 - DNA, 1546 bp, Geobacillus sp.
  WCH70
agagtttgatcctggctcaggacgaacgctggcggcgtgcctaatacatgcaagtcgagcggaccgaacggaagcttgcttctgttcggttagcggcggacgggtgagtaacacgtgggtaacctgcccgtaagaccgggataactccgggaaaccggggctaataccggataacaccgaagaccgcatggtctttggttgaaaggtggcttttgctaccacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagtaccgttcgaatagggcggtacggtgacggtacctaacgagaaagccccggctaactacgtgccagcagccgcggtaatacgtagggggcgagcgttgtccggaattattgggcgtaaagcgcgcgcaggcggtcccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggattaaaccctttagtgctgtagctaacgcgttaagcactccgcctggggagtacggccgcaaggctgaaactcaaaggaattgacgggggcccgcacaagcggtggagcatgtggtttaattcgaagcaacgcgaagaaccttaccaggtcttgacatcccctgacaaccctggagacagggcgttcccccttcgggggggacagggtgacaggtggtgcatggttgtcgtcagctcgtgtcgtgagatgttgggttaagtcccgcaacgagcgcaaccctcgcccctagttgccagcattcagttgggcactctagggggactgccggctaaaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgtaagggagccagccgccgaaggtggggcaagtgattggggtgaagtcgtaacaaggtagccgtaccggaaggtgcggctggatcacct

SEQ ID NO: 936 - DNA, 1523 bp, Geobacillus stearothermophilus
acgaacgctggcggcgtgcctaatacatgcaagtcgagcggaccggattggggcttgccttgattcggtcagcggcggacgggtgagtaacacgtgggcaacctgcccgcaagaccgggataactccgggaaaccggagctaataccggataacaccgaagaccgcatggtcttcggttgaaaggcggcctttgggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgagaaagccccggctaactacgtgccagcagccgcggtaatacgtagggggcgagcgttgtccggaattattgggcgtaaagcgcgcgcaggcggtctcttaagtctgatgtgaaagcccacggctcaaccgtggagggtcattggaaactgggggacttgagggcaggagaggagagcggaattccacgtgtagcggtgaaatgcgtagagatgtggaggaacaccagtggcgaaggcggctctctggcctgcacctgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattcggttgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccttacgggagccagccgccgaaggtggggcaagtgattggggtgaagtcgtaacaaggtagccgtaccggaaggtgcggctggatca

SEQ ID NO: 937 - DNA, 1561 bp, Geobacillus thermocatenulatus
tcttttggagagtttgatcctggctcaggacgaacgctggcggcgtgcytaatacatgcaagtcgagcggaccgaacgggagcttgctctcgtttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtggacggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgagaaagccccggctaactacgtgccagcagccgcggtaatacgtagggggcgagcgttgtccggaattattgggcgtaaagcgcgcgcaggyggccccttaagtctgatgtgaaagcccacggctcaaccgtggagggtcattggaaactggggggcttgagggcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattcaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggcaacccgcaagggagccagccgccgaaggtggggcaagtgattggggtgaagtcgtaacaaggtagccgtaccggaaggtgcggctggatcacctcctttct

SEQ ID NO: 938 - DNA, 1551 bp, Geobacillus thermodenitrificans
agagtttgatcctggctcaggacgaacgctggcggcgtgcctaatacatgcaagtcgagcggaccgaacgagagcttgctcttgttcggtcagcggcggacgggtgagtaacacgtgggcaacctgcccgcaagaccgggataactccgggaaaccggagctaataccggataacaccaaagaccgcatggtctttggttgaaaggcggcttcggctgccacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggccttcgggtcgtaaaagctctgttgtgagggacgaaggagcgccgtttgaataaggcggcgcgggggacggtacctcacgaaaaagcccccggctaactacgtgccagcagccgcggtaatacgtagggggcgagcgttgtccggaattattgggcgtaaaggggcccgcaggcggtcctttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgtaactgacgctgaggcgcgaaagcgtggggagcaaacaggattagataccctggtagtccacgccgtaaacgatgagtgctaagtgttagaggggtcacaccctttagtgctgtagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaacccttgcctctagttgccagcattcagttgggcactctagagggactgccggctaaaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccttacgggagccagccgccgaaggtggggcaagtgattggggtgaagtcgtaacaaggtagccgtaccggaaggtgcggctggatcacctcc

SEQ ID NO: 939 - DNA, 1562 bp, Geobacillus thermoglucosidasius
ctctttggagagtttgatcctggctcaggacgaacgctggcggcgtgcctaatacatgcaagtcgagcggaccgggcgggagcttgcttccgcttggttagcggcggacgggtgagtaacacgtgggtaacctgcccgtaagaccgggataactccgggaaaccggggctaataccggataacaccgaagaccgcatggtcttcggttgaaaggcggcttcggctgccacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagtgccgttcgaacagggcggcacggtgacggtacctaacgagaaagccccggctaactacgtgccagcagccgcggtaatacgtagggggcgagcgttgtccggaattattgggcgtaaagcgcgcgcaggcggtcccttaagtctgatgtgaaagcccacggcttaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagaggggttattccctttagtgctgtagctaacgcgttaagcactccgcctggggagtacggccgcaaggctgaaactcaaaggaattgacgggggcccgcacaagcggtggagcatgtggtttaattcgaagcaacgcgaagaaccttaccaggtcttgacatcccctgacaaccctggagacagggcgttcctcccttgcgggaggacagggtgacaggtggtgcatggttgtcgtcagctcgtgtcgtgagatgttgggttaagtcccgcaacgagcgcaaccctcgcccctagttgccagcattcagttgggcactctagggggactgccggctaaaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgcaagggagccagccgccgaaggtggggcaagtgattggggtgaagtcgtaacaaggtagccgtaccggaaggtgcggctggatcacctcctttct

SEQ ID NO: 940 - DNA, 1546 bp, Geobacillus thermoleovorans
agagtttgatcctggctcaggacgaacgctggcggcgtgcctaatacatgcaagtcgagcggaccaaatcggagcttgctctgatttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcacgaaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggcaacccgcaagggagccagccgccgaaggtggggcaagtgattggggtgaagtcgtaacaaggtagccgtaccggaaggtgcggctggatcacct

SEQ ID NO: 941 - DNA, 1555 bp, Geobacter bemidjiensis
aaactggagagtttgatcctggctcagaacgaacgctggcggcgtgcttaacacatgcaagtcgaacgggatccagagcttgctctggtgagagtggcgcacgggtgagtaacgcgtggataacctgccctggtatctggaataacatctcgaaaggggtgctaataccggataagcctacggagccttcggtctctgcaggaaaaggtggcctctatttataagctaccgtatcaggatgggtccgcgtaccattagctagttggtagggtaatggcctaccaaggctacgatggttagctggtctgagaggatgatcagccacactggaactgagacacggtccagactcctacgggaggcagcagtggggaattttgcgcaatgggggaaaccctgacgcagcaacgccgcgtgagtgatgaaggctttcgggtcgtaaagctctgtcagtagggaagaaatgaaaacggttaatacccgtttttcttgacggtacctacaaaggaagcaccggctaactccgtgccagcagccgcggtaatacggagggtgcaagcgttgttcggatttattgggcgtaaagcgcgtgtaggcggtttcttaagtctgatgtgaaagccctgggctcaacccaggaagtgcattggatactgggagacttgaatacgggagagggtagtggaattcctagtgtaggagtgaaatccgtagatattaggaggaacaccggtggcgaaggcggctacctggaccgatattgacgctgagacgcgaaagcgtggggagcaaacaggattagataccctggtagtccacgccgtaaacgatgagaactaggtgttgcgggtattgacccctgcagtgccgcagctaacgcattaagttctccgcctgggaagtacggtcgcaagactaaaactcaaaggaattgacgggggcccgcacaagcggtggagcatgtggtttaattcgacgcaacgcgcagaaccttacctgggcttgacatctgcggaacctccccgaaacgggagggtgccttcgggagccgcaagacaggtgctgcatggctgtcgtcagctcgtgtcgtgagatgttgggttaagtcccgcaacgagcgcaacccctatccttagttgccatcatttagttgggcactctaaggagactgccggtgtcaaaccggaggaaggtggggatgacgtcaagtcctcatggcccttatgtccagggctacacacgtgctacaatggccggtacaaagagcagcgataccgcgaggtggagccaatctcaaaaagccggtctcagttcggattggagtctgcaactcgactccatgaagttggaatcgctagtaatcgcggatcagcacgccgcggtgaatacgttcccgggccttgtacacaccgcccgtcacaccacgggagtcggttggtcccgaagtgcgtgagctaacccgcaagggaggcagcgtcctaaggaatggccggtgactggggtgaagtcgtaacaaggtagccgtaggggaacctgcggctggatcacctccttt

SEQ ID NO: 942 - DNA, 1485 bp, Gloeobacter violaceus
aaaatggagagtttgatcctggctcaggatgaacgctggcggcgtgcttaacacatgcaagtcgaacgagatcttcggatcgagtggcggacgggtgagtaacacgtgggaatctgccctcaggagggggataacggccggaaacggccgctaataccccatatgccgcaaggtgaaatgaatttcgcctgaggatgagcccgcgtctgattagctagttggtggggtaatggcctaccaaggctacgatcagtagctggtctgagaggatgatcagccacactgggactgagacacggcccagactcctacgggaggcagcagtggggaattttccgcaatgggcgaaagcctgacggagcaacgccgcgtgggtgatgaaggcccgtgggtcgtaaagcccttttgtcagggacgaaacctgacggtacctgacgaataagcatcggctaactccgtgccagcagccgcggtaatacggaggatgcaagcgttatccggaattattgggcgtaaagcgtacgtaggcggccagccaagtctggggtcaaagcccgcagcctaactgcggaaaggccctggaaactggttggctagagtgcggtaggggcaaggggaattcccggtgtagcggtgaaatgtggagatatcgggaagaacaccagcggcgaaagcgccttgctggaccgcaactgacgctgaggtacgaaagccaggggagcaaatgggattagataccccagtagtcctggccgtaaacgatggacactaggtgttgcgcgtatcgacccgtgcagtgccgtagctaacgcgttaagtgtcccgcctggggagtacgcacgcaagtgtgaaactcaaaggaattgacgggggcccgcacaagcggtggagcatgtggtttaattcgatgcaacgcgaagaaccttaccagggcttgacatgtcgcgaatctcgcggaaacgtgggagtgccttcgggaacgcgaacacaggtgctgcatggctgtcgtcagctcgtgtcgtgagatgttgggttaagtcccgcaacgagcgcaaccctcgtcgtcagttgccatcattcagttgggcactctggcgagactgccggtgacaaaccggaggaaggtggggatgacgtcaagtcagcatggctcttacgtcctgggctacacacgtgctacaatggttcggataaagggtcgcaatctcgcgagggggagccaatcccataaaccgaatctcagttcggattgcaggctgcaactcgcctgcatgaagtcggaatcgctagtaatcgcaggtcagcatactgcggtgaatacgttcccgggccttgtacacaccgcccgtcacaccatggaagctggtcatgcccgaagtcggtattctaaccgcaaggagggagccgccgaaggcggggccggtgactggggtgaagtcgtaacaaggtagccgtaccggaaggtgcggctggatcacctccttt

SEQ ID NO: 943 - DNA, 1447 bp, Gluconacetobacter azotocaptans
agcgaacgctggcggcatgcttaacacatgcaagtcgcacgaacctttcggggttagtggcggacgggtgagtaacgcgtagggatctgtccatgggtgggggataacctcgggaaactgaggctaataccgcatgacacctgagggtcaaaggcgtaagtcgcctgtggaggaacctgcgttcgattagctggttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggtcttcggattgtaaagcactttcgacggggacgatgatgacggtacccgtagaagaagccccggctaacttcgtgccacgtgccgcggtaatacgaagggggctagcgttgctcggaatgactgggcgtaaagggcgcgtaggcggtttggacagtcagatgtgaaattcctgggcttaacctgggggctgcatttgatacgtacagactagagtgtgagagagggttgtggaattcccagtgtagaggtgaaattcgtagatattgggaagaacaccggtggcgaaggcggcaacctggctcataactgacgctgaggcgcgaaagcgtggggagcaaacaggattagataccctggtagtccacgctgtaaacgatgtgtgctggatgttgggtggcttagccactcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatggggaggctgtgttcagagatgagcatttcccgcaagggacctcctgcacaggtgctgcatggctgtcgtcagctcgtgtcgtgagatgttgggttaagtcccgcaacgagcgcaaccctcgcctttagttgccagcatgtttgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagctgatctcaaaaagccgtctcagttcggattgcactctgcaactcgggtgcatgaagttggaatcgctagtaatcgcggatcagcatgccgcggtgaatacgttcccgggccttgtacacaccgcccgtcacaccatgggagttggtttgaccttaagccggtgagcgaacccagcaatggggcgcagccgaccacggtcgggtcagcgactggggtgaagtcgtaacaaggtagccgtaggggaactgc

SEQ ID NO: 944 - DNA, 1486 bp, Gluconacetobacter diazotrophicus
agagtttgatcctggctcagagcgaacgctggcggcatgcttaacacatgcaagtcgcacgaacctttcggggttagtggcggacgggtgagtaacgcgtagggatctgtccatgggtgggggataactccgggaaactggagctaataccgcatgacacctgagggtcaaaggcgcgagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggtttggacagtcagatgtgaaattcctgggcttaacctgggggctgcatttgatacgtacagactagagtgtgagagagggttgtggaattcccagtgtagaggtgaaattcgtagatattgggaagaacaccggtggcgaaggcggcaacctggctcataactgacgctgaggcgcgaaagcgtggggagcaaacaggattagataccctggtagtccacgctgtaaacgatgtgtgctggatgttgggtggcttagcccctcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatggggaggctgcagtcagagatggctgtttcccgcaagggacctcctgcacaggtgctgcatggctgtcgtcagctcgtgtcgtgagatgttgggttaagtcccgcaacgagcgcaaccctcgcctttagttgccagcatgattgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagctgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccagcaatggggcgcagccgaccacggtcgggtcagcgactggggtgaagtcgtaacaaggtagccgtaggggaacctgcggctggatcacctccttt

SEQ ID NO: 945 - DNA, 1484 bp, Gluconacetobacter entanii
  modified_base (10)..(11): a, c, t, g, unknown or other
gagtttgatnntggctcagagcgaacgctggcggcatgcttaacacatgcaagtcgcacgaacctttcggggttagtggcggacgggtgagtaacgcgtagggatctgtccatgggtgggggataaccttgggaaaccgaggctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgttacagtcagatgtgaaattcccgggcttaacctgggggctgcatttgatacgtggcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtggcttggccattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggctgtgtccagagatgggcatttctcgcaagagacctccagcacaggtgctgcatggctgtcgtcagctcgtgtcgtgagatgttgggttaagtcccgcaacgagcgcaaccctcgcctttagttgccagcacgtctgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagcggatctccaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaa

SEQ ID NO: 946 - DNA, 1482 bp, Gluconacetobacter europaeus
gagtttgatcatggctcagagcgaacgctggcggcatgcttaacacatgcaagtcgcacgaacctttcggggttagtggcggacgggtgagtaacgcgtagggatctgtccatgggtgggggataactttgggaaactgaagctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgacacagtcagatgtgaaattcctgggcttaacctgggggctgcatttgatacgtggcgactagagtgtgagagagggttgtggaattcccagtgtagaggtgaaattcgtagatatttgggaagaacaccggtggcgaaggcggcaacctggctcatgactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggccgtgtccagagatgggcatttctcgcaagagacctccagcacaggtgctgcatggctgtcgtcagctcgtgtcgtgagatgttgggttaagtcccgcaacgagcgcaaccctcgcctttagttgccatcacgtctgggtgggcactctaaaggaactgccggtgacaagccggaggaaggtggggatgacgtcaagtcctcatggcccttatgtcctgggctacacacgtgctacaatggcggtgacagtgggaagccaggtagcgataccgagccgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctccttt

SEQ ID NO: 947 - DNA, 1481 bp, Gluconacetobacter hansenii
gagtttgattatggctcagagcgaacgctggcggcatgcttaacacatgcaagtcgcacgaacctttcggggttagtggcggacgggtgagtaacgcgtagggatctgtccatgggtgggggataactttgggaaactgaagctaataccgcatgacacctgagggtcaaaggcgcgagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgttacagtcagatgtgaaattcccgggcttaacctgggggctgcatttgatacgtgacgactagagtgtgagagagggttgtggaattcccagtgtagaggtgaaattcgtagatattgggaagaacaccggtggcgaaggcggcaacctggctcatgactgacgctgaggcgcgaaagcgtggggtgcaaacaggattagataccctggtagtccacgctgtaaacgatgtgtgctggatgttggatggcttggccattcggtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccaggacttgacatgcggaggctgtgtccagagatgggcatttctcgcaagagacctccagcacaggtgctgcatggctgtcgtcagctcgtgtcgtgagatgttgggttaagtcccgcaacgagcgcaaccctcgcctttagttgccagcacgtctgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagcggatctccaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctccttt

SEQ ID NO: 948 - DNA, 1447 bp, Gluconacetobacter johannae
agcgaacgctggcggcatgcttaacacatgcaagtcgcacgaacctttcggggttagtggcggacgggtgagtaacgcgtagggatctgtccatgggtgggggataacctcgggaaactgaggctaataccgcatgacacctgagggtcaaaggcgtaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggtttggacagtcagatgtgaaattcctgggcttaacctgggggctgcatttgatacgtatagactagagtgtgagagagggttgtggaattcccagtgtagaggtgaaattcgtagatattgggaagaacaccggtggcgaaggcggcaacctggctcataactgacgctgaggcgcgaaagggtggggagcaaacaggattagataccctggtagtccacgctgtaaacgatgtgtgctggatgttgggtggcttagccactcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatggggaggctgtgagcagagatgttcatttcccgcaagggacctcctgcacaggtgctgcatggctgtcgtcagctcgtgtcgtgagatgttgggttaagtcccgcaacgagcgcaaccctcgcctttagttgccagcatgtttgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagctgatctcaaaaagccgtctcagttcggattgcactctgcaactcgggtgcatgaagttggaatcgctagtaatcgcggatcagcatgccgcggtgaatacgttcccgggccttgtacacaccgcccgtcacaccatgggagttggtttgaccttaagccggtgagcgaacccagcaatggggcgcagccgaccacggtcgggtcagcgactggggtgaagtcgtaacaaggtagccgtaggggaacctgc

SEQ ID NO: 949 - DNA, 1449 bp, Gluconacetobacter oboediens
tgagtttgatcctggctcagagcgaatgctggcggcatgcttaacacatgcaagtcgcacgaacctttcggggttagtggcggacgggtgagtaacgcgtagggatctatccacgggtgggggataactttgggaaactgaagctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggatgatgatgacggtacccgcagaagaagccccggctaacttcgtgccagcagccgcggtaatacgaagggggcaagcgttgctcggaatgactgggcgtaaagggcgcgtaggcggttgacacagtcagatgtgaaattcccgggcttaacctgggggctgcatttgatacgtggcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggccgtgtccagagatgggcatttctcgcaagagacctccagcacaggtgctgcatggctgtcgtcagctcgtgtcgtgagatgttgggttaagtcccgcaacgagcgcaaccctcgcctttagttgccatcacgtctgggtgggcactctaaaggaactgccggtgacaagccggaggaaggtggggatgacgtcaagtcctcatggcccttatgtcctgggctacacacgtgctacaatggcggtgacagtgggaagccaggtggtgacaccgagccgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagc

SEQ ID NO: 950 - DNA, 1493 bp, Gluconacetobacter xylinus
atgaacctgagagtttgatcctggctcagagcgaacgctggcggcatgcttaacacatgcaagtcgcacgaacctttcggggttagtggcggacgggtgagtaacgcgtagggatctgtccatgggtgggggataactttgggaaactgaagctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgacacagtcaggtgtgaaattcccgggcttaacctggggtctgcatttgatacgtggcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggctgtgtccagagatgggcatttctcgcaagagacctccagcacaggtgctgcatggctgtcgtcagctcgtgtcgtgagatgttgggttaagtcccgcaacgagcgcaaccctcgcctttagttgccatcacgtttgggtgggcactctaaaggaactgccggtgacaagccggaggaaggtggggatgacgtcaagtcctcatggcccttatgtcctgggctacacacgtgctacaatggcggtgacagtgggaagccaggtggtgacaccgagccgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctccttt

SEQ ID NO: 951 - DNA, 1472 bp, Gordonia bronchialis
ggacgaacgctggcggcgtgcttaacacatgcaagtcgaacggaaaggcccagcttgctgggtactcgagtggcgaacgggtgagtaacacgtgggtgatctgcccctgactttgggataagcctgggaaactgggtctaataccggatatgaccttacatcgcatggtgtttggtggaaagcttttgcggttggggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcaccagggacgaagcgtgagtgacggtacctggagaagaagcaccggccaactacgtgccagcagccgcggtaatacgtagggtgcgagcgttgtccggaattactgggcgtaaagagctcgtaggcggtttgtcgcgtcgtctgtgaaattctgcagcttaactgtaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacaggattagataccctggtagtccacgccgtaaacggtgggtactaggtgtggggttcatttcacggaatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagacgcggctagagatagtcgttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagctgtcgaaggtgggatcggcgattgggacgaagtcgtaacaaggtagccgtaccgg

SEQ ID NO: 952 - DNA, 1298 bp, Gordonia polyisoprenivorans
gacgaacgctggcggcgtgcttaacacatgcaagtcgaacgagtggcgaacgggtgagtaacacgtgggtgatctgcccctgactttgggataagcctgggaaactgggtctaataccggatatggaaaggcggttggggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcagcagggacgatgacggtacctgcagaagaagcaccggccaactacgtgccagcagccgcggtaatacgtagggtgcgagcgttgtccggaattactgggcgtaaagagctcgtaggcggtttgtcgcgtcgtctgtgaaattctgcagcttaactgtaggcgtgcaggcgatacgggcagacttgagtactacaggggagactggaattcctggtgtagcggtgaaatgcgcagatatcaggaggaacaccggtggcgaaggcgggtctctgggtagactgacgctgaggagcgaaagcgtgggtagcgaacaggattagataccctggtagtccacgccgtaaacggtgggtactaggtgtgggttgatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatatacaggtggtgcatggctgtcgtcagctcgtgtcgtgagatgttgggttaagtcccgcaacgagcgcaacccttgtcctgtattgccagcggccggggacttgcaggagactgccggggtcaactcggaggaaggtggggatgacgtcaagtcatcatgccccttatgtccagggcttcacacatgctacaatggccggcagagggctgcgataccgtgaggtggagcgaatcccttccggtctcagttcggacggggtctgcaactcgaccccggaagtcggagtcgctagtaatcgcagatcagcaacgctgcggtgaatacgttcccgggccttgtacacaccgcccgtcacgtcatgaaagtcggtaacacccgaagccggtgcctagggagctgtcgaaggtgggatcggcgattgggacg

SEQ ID NO: 953 - DNA, 1485 bp, Gordonia sp.
  KTR9
  modified_base (11)..(11): a, c, t, g, unknown or other
  modified_base (415)..(415): a, c, t, g, unknown or other
  modified_base (1483)..(1483): a, c, t, g, unknown or other
agagtttgatncctggctcaggacgaacgctggcggcgtgcttaacacatgcaagtcgaacggaaaggcccagcttgctgggtactcgagtggcgaacgggtgagtaacacgtgggtgatctgccctgcactctgggataagcctgggaaactgggtctaataccggatatgaccaactgtcgcatggtggttggtggaaagcttttgcggtgtgggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcggnttgtaaacctctttcaccagggacgaagcgtgagtgacggtacctggagaagaagcaccggccaactacgtgccagcagccgcggtaatacgtagggtgcgagcgttgtccggaattactgggcgtaaagagctcgtaggcggtttgtcgcgtcgtctgtgaaattctgcaactcaattgtaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacaggattagataccctggtagtccacgccgtaacggtgggtactaggtgtgggttccttttcacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagacgcggctagagatagtcgttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggctggtacagagggctgcgataccgtgaggtggagcgaatcccttaaagccagtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagctgtcgaaggtgggatcggcgattgggacgaagtcgtaaccaaggtancc

SEQ ID NO: 954 - DNA, 1430 bp, Gordonia sputi
tgcaagtcgaacggaaaggcccagcttgctgggtactcgagtggcgaacgggtgagtaacacgtgggtgatctgcccctgactttgggataagcctgggaaactgggtctaataccggatattcatttttcctcgcatggggatttgtggaaagcttttgcggttggggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcagctccgacgaagcgcaagtgacggtaggagcagaagaagcaccggccaactacgtgccagcagccgcggtaatacgtagggtgcaagcgttgtccggaattactgggcgtaaagagctcgtaggcggtttgtcgcgtcgtctgtgaaattctgcagcttaactgcaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacaggattagataccctggtagtccacgccgtaaacggtgggtactaggtgtgggtttcatttcacggaatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagacgcagtcagagatggctgttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggctggtacagagggctgcgagaccgtgaggtggagcgaatcccttaaagccagtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagctgtcgaaggtgggatcggcgattgggacgaagtcgtaacaagg

SEQ ID NO: 955 - DNA, 1467 bp, Gordonia terrae
  modified_base (444)..(445): a, c, t, g, unknown or other
gagtttgatcatggctcaggacgaacgctggcggcgtgcttaacacatgcaagtcgaacggaaaggcccagcttgctgggtactcgagtggcgaacgggtgagtaacacgtgggtgatctgccctgcactctgggataagcctgggaaactgggtctaataccggatatgaccaactgtcgcatggtggttggtggaaagcttttgcggtgtgggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcaccagggacgaagcgnnagtgacggtacctggagaagaagcaccggccaactacgtgccagcagccgcggtaatacgtagggtgcgagcgttgtccggaattactgggcgtaaagagctcgtaggcggtttgtcgcgtcgtctgtgaaattctgcaactcaattgcaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacaggattagataccctggtagtccacgccgtaaacggtgggtactaggtgtgggttccttttcacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagacgcggctagagatagtcgttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggctggtacagagggctgcgataccgtgaggtggagcgaatcccttaaagccagtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagctgtcgaaggtgggatcggcgattgggacgaag

SEQ ID NO: 956 - DNA, 1497 bp, Gordonibacter pamelaeae; identical to SEQ ID NO: 680

SEQ ID NO: 957 - DNA, 1549 bp, Gracilibacter thermotolerans
cctaccatgcagtcgagcggagatttcttcggcactgaacattctagtagtatgacgcaaacaaagcgtcatgaagaaacaccattggtgtatatgataagataaaagtttcttcatcacgcgttaataaagtgccaacacaaacatcaagagaaattagagaaaagaatgtattagaatgttgagtgctgaagaaatcttagcggcggacgggtgagtaacacgtgggcaacctgcctcgaagagggggataacaccgagaaatcggtgctaataccgcataacatacacagaccgcatggtgagtgtatcaaaggagaaatccgctttgagatgggcccgcggctgattagctagttggtaaggtaacggcttaccaaggcgacgatcagtagccgacctgagagggtgaccggccacactggaactgagacacggtccagactcctacgggaggcagcagtggggaatattgcgcaatgggggaaaccctgacgcagcaacgccgcgtggaggaagaaggtcttcggattgtaaactcctgtcttctgggacgaagaatgacggtaccagaggaggaagccacggctaactacgtgccagcagccgcggtaatacgtaggtggcgagcgttgtccggaattactgggcgtaaagggcgcgtaggcggttttttaagtcagatgtgaaaacccagggcttaactctgggattgcatttgaaactggaaggcttgagtgcaggagaggtaagtggaattcctagtgtagcggtgaaatgcgtagatattaggaggaacaccagtggcgaaggcgacttactggactgtaactgacgctgaggcgcgaaagcgtggggagcaaacaggattagataccctggtagtccacgccgtaaacgatggatactaggtgtgggaggtgtcgaccccttccgtgccgcagtaaacgcaataagtatcccgcctggggagtacggccgcaaggttgaaactcaaaggaattgacgggggcccgcacaagcagcggagcatgtggtttaattcgaagcaacgcgaagaaccttaccaggacttgacatcccctgaattactcgtaacggaggaagtccttcgggacagggagacaggtggtgcatggttgtcgtcagctcgtgtcgtgagatgttgggttaagtcccgcaacgagcgcaacccctattgctagttgccatcattaagttgggcactctagtgagactgccggagacaattcggaggaaggtggggatgacgtcaaatcatcatgccccttatgttctgggctacacacgtgctacaatgggtgtaacaacgagaagcgagctagtgatagcaagccaacctctaaaaagcaccctcagttcggattgtaggctgaaacccgcctacatgaagttggagttgctagtaatcgcgaatcagcatgtcgcggtgaatacgttcccgggccttgtacacaccgcccgtcacaccatgggagttggaagcacccgaagccggtgacttaaccgcaaggagagagcctcgaag

SEQ ID NO: 958 - DNA, 1527 bp, Gramella forsetii
atgaagagtttgatcctggctcaggatgaacgctagcggcaggcctaacacatgcaagtcgaacggtaacagggattgcttgcaatccgctgacgagtggcgcacgggtgcgtaacgcgtatacaatctgcctttaagcggggaatagcccatggaaacgtggattaataccccatagtattatgatttcacctgggattataattaaacatttatggcttaaagatgagtatgcgtcctattagttagttggtaaggtaacggcttaccaagacagcgataggtaggggtcctgagagggagatcccccacactggtactgagacacggaccagactcctacgggaggcagcagtgaggaatattggacaatggaggcaactctgatccagccatgccgcgtgcaggaagacggccctatgggttgtaaactgcttttatacgggaagaaccacatctacgtgtagatgcttgacggtaccgtatgaataaggaccggctaactccgtgccagcagccgcggtaatacggagggtccaagcgttatccggaatcattgggtttaaagggtccgtaggcggaataataagtcagtggtgaaagtctgcagctcaactgtagaattgccattgatactgttgttcttgaattattatgaagtggttggaataagtagtgtagcggtgaaatgcatagatattacttagaacacctattgcgaaggcagatcactaataatatattgacgctgagggacgaaagcgtaggtagcgaacaggattagataccctggtagtctacgccgtaaacgatggttactagctgtccggcctaattgagggctgggtggttaagcgaaagtgataagtaacccacctggggagtacgttcgcaagaatgaaactcaaaggaattgacgggggcccgcacaagcggtggagcatgtggtttaattcgatgatacgcgaggaaccttaccagggcttaaatgcagtctgacaggtctggaaacagacttttcttcggacagattgcaaggtgctgcatggttgtcgtcagctcgtgccgtgaggtgtcaggttaagtcctataacgagcgcaacccctgtggttagttgccagcgagtaatgtcgggaactctagccagactgccggtgcaaaccgcgaggaaggtggggatgacgtcaaatcatcacggcccttacgtcctgggccacacacgtgctacaatggtagggacagagggcagctaccccgcgaggggatgcgaatcttcaaaccctatcacagttcggatcgcagtctgcaactcgactgcgtgaagctggaatcgctagtaatcgcatatcagccatgatgcggtgaatacgttcccgggccttgtacacaccgcccgtcaagccatggaagctgggggtacctgaagtccgtcaccgtaaggagcggcctagggtaaaactggtaactggggctaagtcgtaacaaggtagccgtaccggaaggtgcggctggaacacctcctttct

SEQ ID NO: 959 - DNA, 1548 bp, Granulicatella adiacens
atgagagtttgatcctggctcaggacgaacgctggcggcgtgcctaatacatgcaagtcgaacgagagcgaccggtgcttgcactggtcaatctagtggcgaacgggtgagtaacacgtgggtaacctgcccatcagagggggataacatccggaaacggatgctaaaaccgcataggtcttcgaaccgcatggtttgaagaggaaaagaggcgcaagcttctgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggttttcggatcgtaaaactctgttgttagagaagaacaagtgctagagtaactgttagcgccttgacggtatctaaccagaaagccacggctaactacgtgccagcagccgcggtaatacgtaggtggcaagcgttgtccggatttattgggcgtaaagcgagcgcaggcggttccttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattcggttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccaaagtcggtgaggtaaccatttggagccagccgcctaaggtgggatagatgattggggtgaagtcgtaacaaggtagccgtatcggaaggtgcggctggatcacctcctttct

SEQ ID NO: 960 - DNA, 1227 bp, Granulicatella elegans
gtcgaacgagtggcgaacgggtgagtaacacgtgggtaacctgcccatcagagggggataacattcggaaacggatgctaaaaccgcatagggaaaactgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggatttcggttcgtaaaactctgttgttagagaagatgacggtatctaaccagaaagccacggctaactacgtgccagcagccgcggtaatacgtaggtggcaagcgttgtccggatttattgggcgtaaagcgagcgcaggcggtcaattaagtctgatgtgaaagcccccggctcaaccggggagggtcattggaaactggttgacttgagtgcagaagaggagagtggaattccatgtgtagcggtgaaatgcgtagatatatggaggaacaccagtggcgaaggcgactctctggtctgactgacgctgaggctcgaaagcgtgggtagcaaacaggattagataccctggtagtccacgccgtaaacgatgagtgctaagtgttggagcttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccttattactagttgccagcatgggcactctagtgagactgccggtgacaaaccggaggaaggtggggatgacgtcaaatcatcatgccccttatgacttgggctacacacgtgctacaatggatggcaacgagcagcgaactcgcgagggtaagcgaatctcttccattctcagttcggatgtaggctgcaactcgcctacagaagccggaatcgctagtaatcgcggatcagcacgccgcggtgaatacgttcccgggtcttgtacacaccgcccgtcacaccacgagagtttgtaacacccaaagtcggtaggta

SEQ ID NO: 961 - DNA, 1512 bp, Granulicatella paradiacens
agtttgatcatggctcaggacgaacgctggcggcgtgcctaatacatgcaagtcgaacgagagcgaccggtgcttgcactggtcaatctagtggcgaacgggtgagtaacacgtgggtaacctgcccatcagagggggataacattcggaaacggatgctaaaaccgcataggtcttcgaaccgcatggtttgaagaggaaaagaggcgcaagcttctgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggttttcggatcgtaaaactctgttgttagagaagaacaagtgctagagtaactgttagcgccttgacggtatctaaccagaaagccacggctaactacgtgccagcagccgcggtaatacgtaggtggcaagcgttgtccggatttattgggcgtaaagcgagcgcaggcggttccttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattgagttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccaaagtcggtgaggtaaccttttggagccagccgcctaaggtgggatagatgattggggtgaagtcgtaacaaggtagccgta

SEQ ID NO: 962 - DNA, 1445 bp, Granulicatella sp.
  M658/99/3
  modified_base (73)..(73): a, c, t, g, unknown or other
  modified_base (180)..(180): a, c, t, g, unknown or other
acgctggcggcgtgcctaatacatgcaagtcgaacgcagtttcattcaccgagtgcttgcactcaccgaatgnactgagtggcgaacgggtgagtaacacgtgggtaacctgcccatcagtgggggataacagtcggaaacgactgctaataccgcatgattttcaacaccgcatggtgntgaaataaaagacggctttgctgtcgctgatggatggacccgcggcgtattagctagttggtgaggtaacggctcaccaaggcaatgatacgtagccggcctgagagggtaatcggccacattgggactgagacacggcccaaactcctacgggaggcagcagtagggaatcttccgcaatggacgaaagtctgacggagcaacgccgcgtgagtgaagaaggttttcggatcgtaaaactctgttgttagagaagaacaacctcttgagtaactgtaagaggtctgacggtatctaaccagaaagccacggctaactacgtgccagcagccgcggtaatacgtaggtggcaagcgttgtccggatttattgggcgtaaagcgagtgcaggcggttccttaagtctgatgtgaaagcccacggcttaaccgtggagggtcattggaaactggggaacttgagtgcagaagaggagagtggaattccatgtgtagcggtggaatgcgtagatatatggaggaacaccagtggcgaaggcgactctctggtctgtaactgacgctgaggctcgaaagcgtgggtagcaaacaggattagataccctggtagtccacgccgtaaacgatgagtgctaggtgttggagggtttccgcccttcagtgccgcagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttatcattagttgccagcattcagttgggcactctagtgatactgccggtgacaaaccggaggaaggtggggatgacgtcaaatcagcatgccccttatgacttgggctacacacgtgctacaatggatggtacaacgagcagcaaacccgcgagggcaagcgaatctcttaaagccattctcagttcggattgttctctgcaactcgagaacatgaagccggaatcgctagtaatcgcggatcagcacgccgcggtgaatacgttcccgggtcttgtacacaccgcccgtcacaccacgagagtttgtaacacccaaagtcggtgaggtaacccttctgggag

SEQ ID NO: 963 - DNA, 1510 bp, Granulicatella sp.
  oral clone ASC02
  modified_base (743)..(743): a, c, t, g, unknown or other
  modified_base (902)..(902): a, c, t, g, unknown or other
  modified_base (998)..(998): a, c, t, g, unknown or other
  modified_base (1013)..(1013): a, c, t, g, unknown or other
gagagtttgattctggctcaggatgaacgctgacagaatgcttaacacatgcaagtctacttgaacttcggtttgggtggcggacgggtgagtaacgcgtaaagaacttgcctcacagttagggacaacatttggaaacgaatgctaatacctgatattatgattttagggcatcctaagattatgaaagctatatacgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacaatggaccaaaagtctgatccagcaattctgtgtgcacgatgacgtttttcggaatgtaaagtgctttcagttgggaagaaaaaaatgacggtaccaacagaagaagtgacggctaactacgtgccagcagccgcggtaatacgtatgtggcaagcgttgtccggatttattgggcgtaaagcgagcgcaggcggtcaattaagtctgatgtgaaagcccccggctcaaccggggagggtcattggaaactggttgacttgagtgcagaagaggagagtggaattccatgtgtaagcggtgaaatgcgtagatatatggaggaacaccagtggcgaaggcgactctctggtctgtaactgaccgctgagcgctcgaaagcgtgggtagcaanacaggattagatacccctggtagtccacgccgtaaacgatgagtgctaagtgttggagggtttccgcccttcagtgctgcagttaccgcattaagcactccgcctggggagtacgaccgccaaggttgaaactcaaaggaattgagcggggacccgcancaagcggtggagcatgtggtttaattcgaagcaacgcgaagaaccttaccaagtcttgacatcctttgaccactctagagatagagctttcccttncggggacaaagtgancaggtggtgcatggttgtcgtcagctcgtgtcgtgagatgttgggttaagtcccgcaacgagcgcaacccttattactagttgccagcattgagttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccaaagtcggtgaggtaaccttaaggagccagccgcctaaggtgggatagatgattggggtgaagtcgtaacaaggtagccgtatcggaaggtgcggctggaacacctccttc

SEQ ID NO: 964 - DNA, 1327 bp, Granulicatella sp.
  oral clone ASCA05
  modified_base (136)..(136): a, c, t, g, unknown or other
  modified_base (159)..(160): a, c, t, g, unknown or other
  modified_base (427)..(427): a, c, t, g, unknown or other
  modified_base (702)..(702): a, c, t, g, unknown or other
tggcggcgtgcctaatacatgcaagtcgaacgagtggcgaacgggtgagtaacacgtgggtaacctgcccatcagagggggataacattcggaaacggatgctaaaaccgcatagggaaaactgctgatggatggntccgcggtgcattagctagttgnngaggtaacggctcaccaaggcgatgatgcatagccgacctgagagggtgatcggccacattgggactgagacacggcccaaactcctacgggaggcagcagtagggaatcttccgcaatggacgcaagtctgacggagcccgccgtttgagtgaagaaggatttcggttcgtaaaactctgttgttagagaccatgacggtatctaaccagaaagccacggctaactacgcgccagcagccgcggtaatacgtaggtggcaagcgtngtccggatttattgggcgtaaagcgagcgcaggcggtcaattaagtctgatgtgaaagcccccggctcaaccggggagggtcattggaaactggttgacttgagtgcagaagaggagagtggaattccatgtgtagcggtgaaatgcgtagatatatggaggaacaccagtggcgaaggcgactctctggtctgactgacgctgaggctcgaaagcgtgggtagcaaacaggattagataccctggtagtccacgccgtaaacgatgagtgctanatgttggagctacagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttggttaagtccgcaacgagcgcaacccttattactagttgccagcatgggcactctagtgagactgccggtgacaaaccggaggaaggtggggatgacgtcaaatcatcatgccccttatgacttgggctacacacgtgctacaatggatggcaacgagcagcgaactcgcgagggtaagcgaatctcttccattctcagttcggatgtaggctgcaactcgcctacagaagccggaatcgctagtaatcgcggatcagcacgccgcggtgaatacgttcccgggtcttgtacacaccgcccgtcacaccacgagagtttgtaacacccaaagtcggtaggtagccagccgcctaaggtgggatagatgattggggtgaagtcgtaacaaggtagccgtatcggaaggtgcggctggaacac

SEQ ID NO: 965 - DNA, 1560 bp, Granulicatella sp.
  oral clone ASCB09
  modified_base (887)..(887): a, c, t, g, unknown or other
  modified_base (907)..(907): a, c, t, g, unknown or other
  modified_base (993)..(993): a, c, t, g, unknown or other
  modified_base (1055)..(1055): a, c, t, g, unknown or other
gagagtttgatcatggctcaggacgaacgctggcggcgtgcctaatacatgcaagtcgaacgagaagcgaccggtgcttgcactggtcaatctagtggcgaacgggtgagtaacacgtgggtaacctgcccatcagagggggataacattcggaaacggatgctaaaaccgcataggttctttagtcgcatgactgaagaaggaaaagaggcttcggcttctgctgatggatggacccgcggtgcattagctagttggtgaggtaacggctcaccaaggcgatgatgcatagccgacctgagagggtgatcggccacattgggactgagacacggcccaaactcctacgggaggcagcagtagggaatcttccgcaatggacgcaagtctgacggagcaacgccgcgtgagtgaagaaggatttcggttcgtaaaacttctgttgttagagaagaacagcgcatagagtaactgttatgcgtgtgacggtatctaaccagaaagccacggctaactacgtgccagcagccgcggtaatacgtaggtggcaagcgttgtccggatttattgggcgtaaagcgagcgcaggcggtcaattaagtctgatgtgaaagcccccggctcaaccggggagggtcattggaaactggttgacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagatacccctggtagtccacgccgtaaacgatgagtgctaagtgttggagggtttccgcccttcagtgctgcagttaacgcattaagcactccngcctgggtgagtacgaccgncaaggttgaaactcaaaggaattgacggggacccgcacaagcggtggagcatgtggtttaattcgaagcaacgcgaagaaccttanccaagtcttgacatcctttgaccactctagagatagagctttcccttcggggacaaagtgancaggtggtgcatggttgtcgtcagctcgtgtcgtgagatgttgggttaagtcccgcaacgagcagcaaaccacattattactagttgccagcattgagttgggcactctagcgagactgccaggtaacaaacccggaggaaggtggggatgacagtcaaatcatcatgccccttatgacctgggctacacacgtgctacaatggctggtacaacgagttgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggttggaacacctccttc

SEQ ID NO: 966 - DNA, 1331 bp, Granulicatella sp.
  oral clone ASCG05
  modified_base (1154)..(1154): a, c, t, g, unknown or other
gcgtgcctaatacatgcaagtcgaacgagtggcgaacgggtgagtaacacgtgggtaacctgcccatcagagggggataacattcggaaacggatgctaaaaccgcatagggaaaactgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggttttcggatcgtaaaactctgttgttagagaagatgacggtatctaaccagaaagccacggctaactacgtgccagcagccgcggtaatacgtaggtggcaagcgttgtccggatttattgggcgtaaagcgagcgcaggcggttccttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcgactctctggtctgactgacgctgaggctcgaaagcgtgggtagcaaacaggattagataccctggtagtccacgccgtaaacgatgagtgctaagtgttggagcttcagtgcttcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcggcgagcgcaacccttattactagttgccagcatgggcactctagtgagactgccggtgacaaaccggaggaaggtggggatgacgtcaaatcatcatgccccttatgacttgggctacacacgtgctacaatggatggcaacgagcagcgaactcgcgagggtaagcgaatctcttccattctcagttcggatgtaggctgcaactcgcctacagaagccggaatcgctagtaatcncggatcagcacgccgcggtgaatacgttcccgggtcttgtacacaccgcccgtcacaccacgagagtttgtaacacccaaagtcggtaggtagccagccgcctaaggtgggatagatgattggggtgaagtcgtaacaaggtagccgtatcggaaggtgcggctggaacacctcctt

SEQ ID NO: 967 - DNA, 1488 bp, Grimontia hollisae
ctaattgaagagtttgatcatggctcagattgaacgctggcggcaggcctaacacatgcaagtcgagcggcagcgacatgaacaatccttcgggtgcgttcatgggcggcgagcggcggacgggtgagtaaaggctgggaacctgccctgacgagggggataaccactggaaacggtggctaataccgcataatgtcttcggaccaaagagggggactttcgggcctctcgcgtcaggatgggcccagttgggattagctggttggtggggtaaaggctcaccaaggcgacgatccctagctggtttgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagccgtgaggaaggtagcgtagttaatacctgcgttacttgacgttagcggcagaagaagcaccggctaactccgtgccagcagccgcggtaatacggagggtgcgagcgttaatcggaattactgggcgtaaagcgcatgcaggcggtctgttaagcaagatgtgaaagccccgggcttaacctgggagtggcattttgaactggcaggctagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgctgtaaacgatgtctacttggaggctgtggtctagaaccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatcctcagaagccggaagagattctggtgtgccttcgggaactgagagacaggtgctgcatggctgtcgtcagctcgtgttgtgaaatgttgggttaagtcccgcaacgagcgcaacccttatccttgtttgccagcacttcgggtgggaactccagggagactgccggtgataaaccggaggaaggtggggacgacgtcaagtcatcatggcccttacgagtagggctacacacgtgctacaatggtgcatacagagggcagcgagaccgcgaggtggagcgaatcccagaaagtgcatcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggt

SEQ ID NO: 968 - DNA, 1425 bp, Haematobacter sp.
  BC14248
cgaacgctggcggcaggcctaacacatgcaagtcgagcggggacttcggtcctagcggcggacgggtgagtaacgcgtgggaacgtgccctttgcttcggaatagccccgggaaactgggagtaataccggatgagccctttgggggaaagatttatcggcgaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcaccggggaagataatgacggtacccggagaagaagccccggctaactccgtgctagcagccgcggtaatacggagggggctagcgttgttcggaattactgggcgtaaagcgcacgtaggcggatcggtaagtcagaggtgaaatcccggggctcaaccccggaactgcctttgaaactcccggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggcgtcgcgggaccagagatggttctttcagttcggctggacgccacacaggtgctgcatggctgtcgtcagctcgtgtcgtgagatgttcggttaagtccggcaacgagcgcaacccacactcccagttgccatcattcagttgggcactctgggagaactgccgatgataagtcggaggaaggtgtggatgacgtcaagtcctcatggcccttacgggttgggctacacacgtgctacaatggtggtgacaatgggttaatccccaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgacgacggtgcgccaacctcgcaagaggaagcagccggccacggtaggctcagtgactggggggaagtcgtaacaaggtggccgtaggggaacctgcggttg

SEQ ID NO: 969 - DNA, 1543 bp, Haemophilus aegyptius
ttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtagtgtcgagagacgaaagtgcgggactgagaggccgcatgccataggatgagcccaagtgggattaggtagttggtggggtaaaggtctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagcacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccctgggcttaacctaggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttgggggttggggtttaactctggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttac

SEQ ID NO: 970 - DNA, 1544 bp, Haemophilus ducreyi
ttaaattgaagagtttgatcatggctcagattgaacgctggcggcaggcttaacacatgcaagtcgaacggtagcacgaaggggcttgctccttgggtgacgagtggcggacgggtgagtaatgcttgggaatctggcttatggagggggataactacgggaaactgtagctaataccgcgtaatatcttcggattaaagggtgggaccttcgggccacctgccataagatgagcccaagtgggattaggtagttggttaggtaaaggctgaccaagccgacgatctctagctggtctgagaggatgaccagccacactggaactgagacacggtccagactcctacgggaggcagcagtggggaatattgcacaatgggggaaaccctgatgcagccatgccgcgtgaatgaagaaggccttcgggttgtaaagttctttcggtgatgaggaaggcagttttgttaatagcaaaattgattgacgttagtcacagaagaagcaccggctaactccgtgccagcagccgcggtaatacggagggtgcgagcgttaatcggaataactgggcgtaaagggcacgcaggcggttgattaagtgagatgtgaaagccccgggcttaacctgggaattgcatttcatactggtcaactagagtactttagggaggggtagaattccacgtgtagcggtgaaatgcgtagagatgtggaggaataccgaaggcgaaggcagccccttgggaatatactgacgctcatgtgcgaaagcgtggggagcaaacaggattagataccctggtagtccacgctgtaaacgatgtcgatttgggggttggtctttaagactggcgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatagaagaactcagagatgagtttgtgccttcgggaactatgtgacaggtgctgcatggctgtcgtcagctcgtgttgtgaaatgttgggttaagtcccgcaacgagcgcaacccttatcctttgttgccagcatgtagtgatgggaactcaaaggagactgccagtgataaactggaggaaggtggggatgacgtcaagtcatcatggcccttacgagtagggctacacacgtgctacaatggcgtatacagagggcggcaaacctgcaaaggggagcgaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttcgggagggcgtttaccacggtatgattcatgactggggtgaagtcgtaacaaggtaaccgtaggggaacctgcggttggatcacctccttac

SEQ ID NO: 971 - DNA, 1281 bp, Haemophilus sp.
  P2 oral clone MB3_C24
caggcttaacacatgcaagtcgaacgagtggcggacgggtgagtaatgcttgggaatctggcttatggagggggataacgacgggaaactatcgctaataccgcgtagtgaaagatgccataggatgagcccaagtgggattaggtagttggtggggtaaaggcctaccaagccgacgatctctagctggtctgagaggatgaccagccacaccgggactgagacacggcccggactcctacgggaggcagcagtggggaatattgcgcaatgggggcaaccctgacgcagccatgccgcgtgaatgaagaaggccttcgggttgtaaagttctttcggtgacgaggatgacgttaatcacagaagaagcaccggctaactccgtgccagcagccgcggtaatacggaggatgcgagcgttaatcggaataactgggcgtaaagggcacgcaggcggctatttaagtgaggtgtgaaatccccgggcttaacctgggaattgcatttcagactgggtagctagagtactttagggaggggtagaattccacgtgtagcggtgaaatgcgtagagatgtggaggaataccgaaggcgaaggcagccccttgggaatactgacgctcatgtgcgaaagcgtggggagcaaacaggattagataccctggtagtccacgctgtaaacgctgtcgatttggggattgggcttggtgcccgaagctaacgtgataaatcgaccgcctggggagtacggccgcaacgttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcgatcgggaactcaaaggagactgccggtgataaaccggaggaaggtggggatgacgtcaagtcatcatggcccttacgagtagggctacacacgtgctacaatggcgtacagagggcgacgaagccgcgaggtggagtgaatctcactacgtctaagtccggatggagtctgcaactcgactccagaagtcggaatcgctagtaatcgcgaatcagaatgtcgcggtgaatacgttcccgggccttgtacacaccgcccgtcacaccatgggagtgggttgtaccagaagtagatgcttagggcgtttaccacggtatgattcatgactggggtg

SEQ ID NO: 972 - DNA, 1296 bp, Haemophilus sp.
  P3 oral clone MB3_C38
attgaacgctggcggcaggcttaacacatgcaagtcgaacgagtggcggacgggtgagtaatgcttgggaatctggcttatggagggggataacgacgggaaactgtcgctaataccgcgtagagaaagatgccataggatgagcccaagtgggattaggtagttggtggggtaatagcctaccaagccgacgatctctagctggtctgagaggatgaccagccacaccgggactgagacacggcccggactcctacgggaggcagcagtggggaatattgcgcaatgggggcaaccctgacgcagccatgccgcgtgaatgaagaaggccttcgggttgtaaagttctttcggtattgaggatgacgttaaatacagaagaagcaccggctaactccgtgccagcagccgcggtaatacggagggtgcgagcgttaatcggaataactgggcgtaaagggcacgcaggcggacttttaagtgaggtgtgaaatccccgggcttaacctgggaattgcatttcagactgggagtctagagtactttagggaggggtagaattccacgtgtagcggtgaaatgcgtagagatgtggaggaataccgaaggcgaaggcagccccttgggaatactgacgctcatgtgcgaaagcgtggggagcaaacaggattagataccctggtagtccacgctgtaaacgctgtcgatttggggattgggcttggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcgatcgggaactcaaaggagactgccggtgataaaccggaggaaggtggggatgacgtcaagtcatcatggcccttacgagtagggctacacacgtgctacaatggcgtacagagggcgacgaagccgcgaggtggagtgaatctcactacgtctaagtccggatggagtctgcaactcgactccagaagtcggaatcgctagtaatcgcgaatcagaatgtcgcggtgaatacgttcccgggccttgtacacaccgcccgtcacaccatgggagtgggttgtaccagaagtagatgcttagggcgtttaccacggtatgattcatgactggggtg

SEQ ID NO: 973 - DNA, 1486 bp, Haemophilus haemolyticus
gctcagattgaacgctggcggcaggcttaacacatgcaagtcgaacggtagcaggagaaagcttgctttcttgctgacgagtggcggacgggtgagtaatgcttgggaatctggcttatggagggggataactacgggaaactgtagctaataccgcgtagtgtcgagagacgaaagtgcgggaccgcaaggccgcatgccatgagatgagcccaagtgggattaggtagttggtggggtaaaggcctaccaagcctgcgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggagtgtatgttaatagcatacattattgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggcttaaagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaattctgtagagatacgggagtgccttcgggaaccatgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcgtatacagagggtggcgaaactgcgaggtggagcgaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccgcaaggggggcgtttaccacggtatgattcatgactggggtgaagtcgtaacaaggtaac

SEQ ID NO: 974 - DNA, 1544 bp, Haemophilus influenzae
ttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagcacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccctgggcttaacctaggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttact

SEQ ID NO: 975 - DNA, 1424 bp, Haemophilus parahaemolyticus
cccaatgcaagtcgaacggtaacagggattagcttgctaatttgctgacgagtggcggacgggtgagtaatgcttgggaatctggcttatggagggggataactacgggaaactgtagctaataccgcgtaaaatcttcggattaaagggtgggactttcgggccacctgccataagatgagcccaagtgggattaggtagttggttaggtaaaggctgaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgacgaggaaggttgataggttaatagcctatcaaattgacgttaatcacagaagaagcaccggctaactccgtgccagcagccgcggtaatacggggggtgcgagcgttaatcggaataactgggcgtaaagggcacgcaggcggtgacttaagtgagatgtgaaagccccgggcttaacctgggaattgcatttcatactgggtcgctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgatgtcgatttggggattgggctttgagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatacgagagtgccttcgggaaccatgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgagtagggctacacacgtgctacaatggcgtatacagagggaagcgagcctgcgagggggagcaaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttcgggagggcgttacccacggtagat

SEQ ID NO: 976 - DNA, 1543 bp, Haemophilus parainfluenzae
ttgaattgaagagtttgatcatggctcagattgaacgctggcggcaggcttaacacatgcaagtcgaacggtaacatgaagaagcttgcttctttgatgacgagtggcggacgggtgagtaatgcttgggaatctagcttatggagggggataactacgggaaactgtagctaataccgcgtagtatcggaagatgaaagtgtgggaccttcgggccacatgccataggatgagcccaagtgggattaggtagttggtgaggtaaaggctcaccaagccgacgatctctagctggtctgagaggatgaccagccacactgggactgagacacggcccagactcctacgggaggcagcagtggggaatattgcgcaatgggggcaaccctgacgcagccatgccgcgtgaatgaagaaggccttcgggttgtaaagttctttcggtagcgaggaaggcatttagtttaatagactaggtgattgacgttaactacagaagaagcaccggctaactccgtgccagcagccgcggtaatacggagggtgcgagcgttaatcggaataactgggcgtaaagggcacgcaggcggtgacttaagtgaggtgtgaaagccccgggcttaacctgggaattgcatttcatactgggtcgctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgatgtcgatttgggggttgagctttaagcttggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaacattccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacagagggaagcgagagtgcgagctggagcgaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttcgggggggcgtttaccacggtatgattcatgactggggtgaagtcgtaacaaggtaaccgtaggggaacctgcggttggatcacctccttac

SEQ ID NO: 977 - DNA, 1471 bp, Haemophilus paraphrophaemolyticus
  modified_base (16)..(16): a, c, t, g, unknown or other
  modified_base (29)..(29): a, c, t, g, unknown or other
  modified_base (50)..(50): a, c, t, g, unknown or other
  modified_base (81)..(81): a, c, t, g, unknown or other
  modified_base (85)..(85): a, c, t, g, unknown or other
  modified_base (132)..(132): a, c, t, g, unknown or other
  modified_base (366)..(366): a, c, t, g, unknown or other
  modified_base (368)..(368): a, c, t, g, unknown or other
  modified_base (478)..(478): a, c, t, g, unknown or other
  modified_base (488)..(488): a, c, t, g, unknown or other
  modified_base (497)..(497): a, c, t, g, unknown or other
  modified_base (499)..(500): a, c, t, g, unknown or other
  modified_base (505)..(505): a, c, t, g, unknown or other
  modified_base (624)..(624): a, c, t, g, unknown or other
  modified_base (653)..(653): a, c, t, g, unknown or other
  modified_base (666)..(666): a, c, t, g, unknown or other
  modified_base (785)..(785): a, c, t, g, unknown or other
  modified_base (838)..(838): a, c, t, g, unknown or other
  modified_base (959)..(959): a, c, t, g, unknown or other
  modified_base (1084)..(1084): a, c, t, g, unknown or other
  modified_base (1161)..(1161): a, c, t, g, unknown or other
  modified_base (1262)..(1262): a, c, t, g, unknown or other
  modified_base (1452)..(1452): a, c, t, g, unknown or other
tgaagagtttgatcanggctcagattgancgctggcggcaggcttaacanatgcaagtcgaacggtaacagggattagctngctnattgctgacgagtggcggacgggtgagtaatgcttgggaatctggcntatggagggggataactacgggaaactgtagctaataccgcgtaatatcggaagattaaagggtgggactttcgggccacctgccataagatgagcccaagtgggattaggtagttggttaggtaaaggctgaccaagccgacgatctctagctggtctgagaggatgaccagccacactggaactgagacacggtccagactcctacgggaggcagcagtggggaatattgcncnatggggggaaccctgatgcagccatgccgcgtgaatgaagaaggccttcgggttgtaaagttctttcggtgacgaggaaggttgataggttaatagcctatcaaattgangttaattacngaagaagcncnngctanctccgtgccagcagccgcggtaatacggagggtgcgagcgttaatcggaataactgggcgtaaagggcacgcaggcggtgacttaagtgagatgtgaaagccccgggcttaacctgggnattgcatttcatactgggtcgctagagtnctttagggagggntagaattccacgtgtagcggtgaaatgcgtagagatgtggaggaataccgaaggcgaaggcagccccttgggaatgtactgacgctcatgtgcgaaagcgtggggagcaaacaggattngataccctggtagtccacgctgtaaacgatgtcgatttggggattgggctttnagcttggtgcccgtagctaacgtgataaatcgaccgcctggggagtacggccgcaaggttaaaactcaaatgaattgacgggggccgcacaagcggtggagcatgtggtttaattcgatgnaacgcgaagaaccttacctactcttgacatccatggaatcttgtagagatacgagagtgccttcgggaaccatgagacaggtgctgcatggctgtcgtcagctcgtgttgtgaaatgttgggttnagtcccgcaacgagcgcaacccttatcctttgttgccagcggtttggccgggaactcaaaggagactgccagtgatnaactggaggaaggtggggatgacgtcaagtcatcatggcccttacgagtagggctacacacgtgctacaatggcgtatacagagggaagcaatcctgcganggggagcaaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccgcaaggggggngtttaccacggtatgattc

SEQ ID NO: 978 - DNA, 1394 bp, Haemophilus parasuis
taacacatgcaagtcgaacggtagcaggaagaagcttgcttctttgctgacgagtggcggacgggtgagtaatgcttgggaatctggcttatggagggggataactacgggaaactgtagctaataccgcgtagtatcttcagatgaaagggtgggaccgcaaggccagttgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaagggtagtgttttaatagaacattacattgacgttagtcacagaagaagcaccggctaactccgtgccagcagccgcggtaatacggagggtgcgagcgttaatcggaatgactgggcgtaaagggcacgcaggcggtgacttaagtgagatgtgaaagccccgagcttaacttgggaattgcatttcatactgggttgctagagtattttagggaggggtagaattccacgtgtagcggtgaaatgcgtagagatgtggaggaataccgaaggcgaaggcagccccttgggaaaatactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagaactcagagatgagtttgtgccttcgggaacttagagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggtgcatacagagggtgacgaagccgcgaggtggagtgaatctcagaaagtgcatctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagct

SEQ ID NO: 979 - DNA, 1543 bp, Haemophilus somnus
ttaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgagaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgataatcacagaagaagcaccggctaactccgtgccagcagccgcggtaatacggagggtgcgagcgttaatcggaatgactgggcgtaaagggcacgcaggtggtgacttaagtgaggtgtgaaatccccgggcttaacctgggaacagcatttcagactgggtgactagagtactttagggaggggtagaattccacgtgtagcggtgaaatgcgtagagatgtggaggaataccgaaggcgaaggcagccccttgggaagatactgacgctcgagtgcgaaagcgtggggagcaaacaggattagataccctggtagtccacgctgtaaacgatgtcgatttggggattgggtgaacacttggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagccgccagagatggtggtgtgcctacgggagcttagagacaggtgctgcatggctgtcgtcagctcgtgttgtgaaatgttgggttaagtcccgcaacgagcgcaacccttatcctttgttgccagcatgttagggtgggaactcaaaggagactgccggtgataaactggaggaaggtggggatgacgtcaagtcatcatggcccttacgagtagggctacacacgtgctacaatggcgtatacagagggaggcgagcctgcgagggtaagcgaagctcagaaagtacgtctaagtccggattggagtctggaactcgactccatgaagtcggaatcgctagtaatcgcggatcagaatgtcgcggtgaatacgttcccgggccttgtacacaccgcccgtcacaccatgggagtgggttgtaccagaagtagatagcttaacgaaagggggcgtttaccacggtatggttcatgactggggtgaagtcgtaacaaggtaaccgtaggggaacctgcggttggatcacctcctta

SEQ ID NO: 980 - DNA, 1393 bp, Haemophilus sp.
  70334
gcaagtcgaacggtagcaggagaaagcttgctttcttgctgacgagtggcggacgggtgagtaatgcttgggaatctggcttatggagggggataactacgggaaactgtagctaataccgcgtaatatcgaaagattaaagtgtgggaccttcgggccacatgccatgggatgagcccaagtgggattaggtagttggtggggtaaaggcctaccaagcctgcgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagtacatcttattgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgatttggtcgggaactcaaaggagactgccagtgataaactggaggaaggtggggatgacgtcaagtcatcatggcccttacgagtagggctacacacgtgctacaatggcgtatacagagggtggcgaaactgcgaggtggagcgaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccgc

SEQ ID NO: 981 - DNA, 1513 bp, Haemophilus sp.
  HK445
agagtttgatcatggctcagattgaacgctggcggcaggcttaacacatgcaagtcgaacggtaacaggrgaaagcttgctttcttgctgacgagtggcggacgggtgagtaatgcttgggaatctggcttacggagggggataactgcgggaaactgcagctaataccgcgtaatatcttaggattaaagggggcrtttgctccagccgtgagatgagcccaagtgggattaggtagttggtgaggtaatggctcaccaagcctgcgatctctagctggtctgagaggatggccagccacaccgggactgagacacggcccggactcctacgggaggcagcagtggggaatattgcgcaatggggggaaccctgacgcagccatgccgcgtgaatgaagaaggccttcgggttgtaaagttctttcggtgacgaggaaggtacttaggttaataccctaagyaattgacgttaatcacagaagaagcaccggctaactccgtgccagcagccgcggtaatacggagggtgcgagcgttaatcggaataactgggcgtaaagggcacgcaggcggatttttaagtgaggtgtgaaagcccckggcttaacctgggaattgcatttcagactgggaatctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttgggggttgggctttaagcttggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaagagactagagatagtcttgtgccttcgggagctttgagacaggtgctgcatggctgtcgtcagctcgtgttgtgaaatgttgggttaagtcccgcaacgagcgcaacccttatcctttgttgccagcgattaggtcgggaactcaaaggagactgccggtgataaaccggaggaaggtggggatgacgtcaagtcatcatggcccttacgagtagggctacacacgtgctacaatggcgtatacagagggaagcgaagcagcgatgtggagcgaatctcataaagtgcgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttcgggggggcgtttaccacggtatgattcatgactggggtgaagtcgtaacaaggtaaccgtaggggaacctgcggct

SEQ ID NO: 982 - DNA, 1361 bp, Haemophilus sp.
  oral clone ASCA07
  modified_base (1337)..(1337): a, c, t, g, unknown or other
gagtttgatcatggctcagattgaacgctggcggcaggcttaacacatgcaagtcgaacgagtggcggacgggtgagtaatgcttgggaatctggcttatggagggggataactacgggaaactgtagctaataccgcgtagtgaaagatgccatgagatgagcccaagtgggattaggtagttggtggggtaaaggcctaccaagcctgcgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggatgacgttaaatacagaagaagcaccggctaactccgtgccagcagccgcggtaatacggagggtgcgagcgttaatcggaataactgggcgtaaagggcacgcaggcggttatttaagtgaggtgtgaaagcccccggcttaacctgggaattgcatttcagacgggataactagagtactttagggaggggtagaatcccacgtgtagcggtgaaatgcgtagagatgtggaggaatacccggggcgaaggcagccccttgggaatactgacgctcatgtgcgaaagcgtggggagcaaacaggattagataccctggtagtccacgctgtaaacgctgtcgatttggggattgggcttggtgcccgtagctaacgtgataaatcgaccgcctggggagtacggccgcaaggttaaaactcaaatgaattgaccggggcccgcacaagccgtggagcatgtggtttaattcgatgcaacgcgaagaaccttacctactcttgacatcgacaggtgctgcatggctgtcgtcagctcgtgttgtgaaatgttgggttaagtcccgcaacgagcgcaaccttatcctttgttgccagcgatcgggaactcaaaggagactgccgtgataaacggaggaaggtgggatgacgtcaagtcatcatggcccttacgagtagggctacacacgtgctacaatggcgtacagagggtggcgaaactgcgaggtggagcgaatctcagtacgtctaagtccggatggagtctgcaactcgactccagaagtcggaatcgctagtaatcgcgaatcagaatgtcgcggtgaatacgttcccgggccttgtacacaccgcccgtcacaccatgggagtgggttgtaccagaagtagatgcttagggcgtttaccacggtatgattcatgactggggtgaagtcgtaacaaggtaaccgtagggnaacctgcggctggatcacctcctt

SEQ ID NO: 983 - DNA, 1329 bp, Haemophilus sp.
  oral clone ASCG06
  modified_base (579)..(579): a, c, t, g, unknown or other
gagtttgattatggctcagattgaacgctggcggcaggcttaacacatgcaagtcgaacgagtggcgaacgggtgagtgatgcttgggaatctggcttatggagggggataactacgggaaactgtagctaataccgcgaggtgaaagatgccatgggatgagcccaagtgggattaggtagttggtggggtaaaggcctaccaagcctgcgatctctagctggtctgagaggatggccagccacactggaactgagacacggtccagactcctacgggaggcagcagtggggaatattgcgcaatggggggaaccctgacgcagccatgccgcgtgaatgaagaagccttcgggtgtaaagttctttcggtattgaggatgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaatnccacgtgtagcggtgaaatgcgtagagatgtggaggaataccgaaggcgaaggcagccccttgggaatactgacgcacaagtgccaaagcgtggggagcaaacaggattagataccctggtagtccacgctgtaaacgtgccgatttggggattgggcttggtccccgtagctaacgtgataatcgaccgcctggggagtacggccgcaaggttaaaacccaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcgatcgggaactcaaaggagactgccagtgataaactggaggaaggtggggatgacgtcaagtcatcatggcccttacgagtagggctacacacgtgctacaatggcgtacagagggtggcgaagctgcgaggtggagcgaatctcagtacgtctaagtccggatggagtctgcaactcgactccagaagtcggaatcgctagtaatcgcgaatcagaatgtcgcggtgaatacgttcccgggccttgtacacaccgcccgtcacaccatgggagtgggttgtaccagaagtagatgcttagggcgtttaccacggtatgattcatgactggggtgaagtcgtaacaaggtaac

SEQ ID NO: 984 - DNA, 1536 bp, Haemophilus sp.
  oral clone BJ021
ttaagagtttgatcatggctcagattgaacgctggcggcaggcttaacacatgcaagtcgaacggtaacagggattagcttgctaatttgctgacgagtggcggacgggtgagtaatgcttgggaatctggcttatggagggggataactacgggaaactgtagctaataccgcgtaaaatcttcggattaaagggtgggactttcgggccacctgccatgagatgagcccaagtgggattaggtagttggttaggtaaaggctgaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgacgaggaaggttggtatgttaatagcatatcaaattgacgttaatcacagaagaagcaccggctaactccgtgccagcagccgcggtaatacggggggtgcgagcgttaatcggaataactgggcgtaaagggcacgcaggcggtgacttaagtgagatgtgaaagccccgggcttaacctgggaattgcatttcatactgggtcgctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgatgtcgatttggggattgggctttaagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatacgagagtgccttcgggaaccatgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgtatacagagggaagcaatcctgcgagggggagcaaatctcagaaagtgcgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccgcaaggggggcgtttaccacggtatgattcatgactggggtgaagtcgtaacaaggtaaccgtaggggaacctgcggctggaacacctccttc

SEQ ID NO: 985 - DNA, 1533 bp, Haemophilus sp.
  oral clone BJ095
agagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataactacgggaaactgcagctaataccgcgtagtatcggaagatgaaagtgcgggaccgcaaggccgcatgccatgagatgagcccaagtgggattaggtagttggtggggtaaaggcctaccaagcctgcgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggagtgtatgttaatagcatacattattgacgttaaatacagaagaagcaccggctaactccgtgccagcagccgcggtaatacggagggtgcgagcgttaatcggaataactgggcgtaaagggcacgcaggcggttatttaagtgaggtgtgaaagccctgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgatgtcgatttggggattgggctttaagcttggtgcccgtagctaacgtgataaatcgaccgcctggggagtacggccgcaaggttaaaactcaaatgaattgacgggggcccgcacaagcggtggagcatgtggtttaattcgatgcaacgcgaaaaaccttacctactcttgacatccatggaatcctgtagagatacgggagtgccttcgggaaccatgagacaggtgctgcatggctgtcgtcagctcgtgttgtgaaatgttgggttaagtcccgcaacgagcgcaacccttatcctttgttgccagcgatccggtcgggaactcaaaggagactgccagtgataaactggaggaaggtggggatgacgtcaagtcatcatggcccttacgagtagggctacacacgtgctacaatggcgtatacagagggtggcgatgccgcgaggtggagcgaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagacagcttaaccgcaaggggggcgtttaccacggtatgattcatgactggggtgaagtcgtaacaaggtaaccgtargggaacctgcggctggatcacctccttc

SEQ ID NO: 986 - DNA, 1364 bp, Haemophilus sp.
  oral clone JM053
gagtttgatcatggctcagattgaacgctggcggcaggcttaacacatgcaagtcgaacgagtggcggacgggtgagtaatgcttgggaatctggcttatggagggggataacgacgggaaactgtcgctaataccgcgtagagaaagatgccatgagatgagcccaagtgggattaggtagttggtggggtaaaggcctaccaagccgacgatctctagctggtctgagaggatgaccagccacaccgggactgagacacggcccggactcctacgggaggcagcagtggggaatattgcgcaatgggggcaaccctgacgcagccatgccgcgtgaatgaagaaggccttcgggttgtaaagttctttcggtgacgaggatgacgttaatcacagaagaagcaccggctaactccgtgccagcagccgcggtaatacggagggtgcgagcgttaatcggaataactgggcgtaaagggcacgcaggcggctatttaagtgaggtgtgaaatccccgggcttaacctgggaattgcatttcagactgggtagctagagtactttagggaggggtagaattccacgtgtagcggtgaaatgcgtagagatgtggaggaataccgaaggcgaaggcagccccttgggaatactgacgctcatgtgcgaaagcgtggggagcaaacaggattagataccctggtagtccacgctgtaaacgctgtcgatttggggattgggcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcgatcgggaactcaaaggagactgccggtgataaaccggaggaaggtggggatgacgtcaagtcatcatggcccttacgagtagggctacacacgtgctacaatggcgtacagagggtgacgaagccgcgaggtggagtgaatctcagtacgtctaagtccggatggagtctgcaactcgactccagaagtcggaatcctagtaatcgcgaatcagaatgtcgcggtgaatacgttcccgggccttgtacacaccgcccgtcacaccatgggagtgggttgtaccagaagtagatgcttagggcgtttaccacggtatgattcatgactggggtgaagtcgtaacaaggtaaccgtaggggaacctgcggttggatcacctcctt

SEQ ID NO: 987 - DNA, 1528 bp, Haemophilus sp.
  oral taxon 851
agagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataactacgggaaactgtagctaataccgcgtagtatcggaagatgaaagtgcgggaccgcaaggccgcatgccatgagatgagcccaagtgggattaggtagttggtggggtaaaggcctaccaagcctgcgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagtacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggcttaaagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgatttggtcgggaactcaaaggagactgccagtgataaactggaggaaggtggggatgacgtcaagtcatcatggcccttacgagtagggctacacacgtgctacaatggcgtatacagagggtggcgaagctgcgaggtggagcgaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccgcaaggggggcgtttaccacggtatgattcatgactggggtgaagtcgtaacaaggtaaccgtaggggaacctgcggttggatcacct

SEQ ID NO: 988 - DNA, 1522 bp, Haemophilus sputorum
agagtttgatcatggctcagattgaacgctggcggcaggcttaacacatgcaagtcgaacggtaacaggaagaaagcttgctttctttgctgacgagtggcggacgggtgagtaatgcttgggaatctggcttatggagggggataactacgggaaactgtagctaataccgcgtaatatcgagagattaaagggtgggaccgcaaggccacctgccatgagatgagcccaagtgggattaggtagttggtgaggtaaaggctcaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtagcgaggaaggcatttagtttaatagactagatgattgacgttaactacagaagaagcaccggctaactccgtgccagcagccgcggtaatacggggggtgcgagcgttaatcggaataactgggcgtaaagggcacgcaggcggtgacttaagtgagatgtgaaagccccgggcttaacctgggaattgcatttcatactgggtcgctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgatgtcgatttgggggttgggctttaagcttggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattaggtcgggaactcaaaggagactgccggtgataaaccggaggaaggtggggatgacgtcaagtcatcatggcccttacgagtagggctacacacgtgctacaatggcgtatacagagggaagcaatcctgcgagggggagcaaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttcgggggggcgtttaccacggtatgattcatgactggggtgaagtcgtaacaaggtaaccgtaggggaacctgcggttg

SEQ ID NO: 989 - DNA, 1421 bp, Hafnia alvei
  modified_base (421)..(421): a, c, t, g, unknown or other
  modified_base (538)..(538): a, c, t, g, unknown or other
  modified_base (1359)..(1359): a, c, t, g, unknown or other
catgcaagtcgagcggtagcacaagagagcttgctctctgggtgacgagcggcggacgggtgagtaatgtctgggaaactgcctgatggagggggataactactggaaacggtagctaataccgcatgacgtcttcggaccaaagtgggggaccttcgggcctcacgccatcagatgtgcccagatgggattagctagtaggtggggtaatggctcacctaggcgacgatctctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttngtgattgacgttactcgcagaagaagcaccggctaactccgtgccagcagccgcggtaatacggagggtgcaagcgttaatcggaattactgggcgtaaagcgcacgcaggcggttngttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgctagagatagcttagtgccttcgggaactctgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacancatgggagtgggttgcaaaagaagtaggtagcttaaccttcgggagggcgcttaccactttg

SEQ ID NO: 990 - DNA, 1533 bp, Halomonas elongata
agagtttgatcatggctcagattgaacgctggcggcaggcctaacacatgcaagtcgagcggaaacgatcctagcttgctaggaggcgtcgagcggcggacgggtgagtaatgcataggaatctgcccggtagtgggggataacttgaggaaactcaagctaataccgcatacgccctacgggggaaagcaggggctcttcggaccttgcgctatcggatgagcttatgtcggattagctggttggtgaggtaacggctcaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggccctcgggttgtaaagcactttcagcgaggaagaatgcttgtcggttaatacccggcaagggagacatcactcgcagaagaagcaccggctaactccgtgccagcagccgcggtaatacggagggtgcgagcgttaatcggaattactgggcgtaaagcgtgcgtaggcggcttgataagccggttgtgaaagccccgggctcaacctgggaacggcatccggaactgttaggctagagtgcaggagaggaaggtagaattcccggtgtagcggtgaaatgcgtagagatcgggaggaataccagtggcgaaggcggccttctggactgacactgacgctgaggtacgaaagcgtgggtagcaaacaggattagataccctggtagtccacgccgtaaacgatgtcgactagccgttggggtcctcgagacctttgtggcgcagttaacgcactaagtcgaccgcctggggagtacggccgcaaggttaaaactcaaatgaattgacgggggcccgcacaagcggtggagcatgtggtttaattcgatgcaacgcgaagaaccttacctacccttgacatcgtgcgaactttccagagatggattggtgccttcgggagcgcacagacaggtgctgcatggctgtcgtcagctcgtgttgtgaaatgttgggttaagtcccgtaacgagcgcaacccttgtccctatttgccagcgattcggtcgggaactctagggagactgccggtgacaaaccggaggaaggtggggacgacgtcaagtcatcatggcccttacgggtagggctacacacgtgctacaatggccggtacaatgggttgcaaagcggcgacgtggagctaatctcataaagccggtctcagtccggatcggagtctgcaactcgactccgtgaagtcggaatcgctagtaatcgtgcatcagaatggcacggtgaatacgttcccgggccttgtacacaccgcccgtcacaccatgggagtggactgcaccagaagtggttagcctaacttcggagggcgatcaccacggtgtggttcatgactggggtgaagtcgtaacaaggtagccgtaggggaacctgcggctggatcacctccttaat

SEQ ID NO: 991 - DNA, 1296 bp, Halomonas johnsoniae
attgaacgctggcggcaggcctaacacatgcaagtcgagcgagcggcggacgggtgagtaatgcataggaatctgcccgatagtgggggataacctggggaaacccaggctaataccgcatacggaaagccgctatcggatgagcctatgtcggattagctagttggtgaggtaaaggctcaccaaggcgacgatccgtagctggtctgagaggatgatcagccacatcgggactgagacacggcccgaactcctacgggaggcagcagtggggaatattggacaatggggggaaccctgatccagccatgccgcgtgtgtgaagaaggccctcgggttgtaaagcactttcagtgaggaagaagacatcactcacagaagaagcaccggctaactccgtgccagcagccgcggtaatacggagggtgcgagcgttaatcggaattactgggcgtaaagcgcgcgtaggtggcttgataagccggttgtgaaagccccgggctcaacctgggaacggcatccggaactgtcaagctagagtgcaggagaggaaggtagaattcccggtgtagcggtgaaatgcgtagagatcgggaggaataccagtggcgaaggcggccttctggactgactgacactgaggtgcgaaagcgtgggtagcaaacaggattagataccctggtagtccacgccgtaaacgatgtcgaccagccgttgggtactttgtggcgaagttaacgcgataagtcgaccgcctggggagtacggccgcaaggttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgtaacgagcgcaacccttgtccttatttgccagcgcgcgggaactctaaggagactgccggtgacaaaccggaggaaggtggggacgacgtcaagtcatcatggcccttacgagtagggctacacacgtgctacaatggtcggcaaagggttgccaactcgcgagagtgagccaatcccgaccgatctcagtccggacggagtctgcaactcgactccggaagtcggaatcgctagtaatcgtggatcagaatgccacggtgaatacgttcccgggccttgtacacaccgcccgtcacaccatgggagtggactgcaccagaagtggttgcctagggcgatcaccacggtgtggttcatgactggggtg

SEQ ID NO: 992 - DNA, 1430 bp, Halorubrum lipolyticum
aggccattgctattgggattcgatttagccatgctagtcgcacgagttcagactcgtggcgaatagctcagtaacacgtggccaaactacccttcggagcacaataccctcgggaaactgaggctaatagtgcataccacagtccacctggaatgaggactgtgccaaacgctccggcgccgaaggatgtggctgcggccgattaggtagacggtggggtaacggcccaccgtgccaataatcggtacgggtcatgagagtgagaacccggagacggaatctgagacaagattccgggccctacggggcgcagcaggcgcgaaacctttacactgcacgccagtgcgataagggaatcccaagtgcgtaggcatagagcctacgcttttgtccaccgtagggaggtggacgaataagggctgggcaagaccggtgccagccgccgcggtaataccggcagcccgagtgatggccgatcttattgggcctaaagcgtccgtagctggccgcacaagtccatcggaaaatccacccgctcaacgggtgggcgtccggtggaaactgtgtggcttgggaccggaaggcgcgacgggtacgtccggggtaggagtgaaatcccgtaatcctggacggaccgccgatggcgaaagcacgtcgcgaggacggatccgacagtgagggacgaaagccagggtctcgaaccggattagatacccgggtagtcctggccgtaaacaatgtctgttaggtgtggctcccactacgagtgggtgctgtgccgtagggaagccgctaaacagaccgcctgggaagtacgtccgcaaggatgaaacttaaaggaattggcgggggagcactacaaccggaggagcctgcggtttaattggactcaacgccggacatctcaccagcatcgactgtaataatgacgatcaggttgatgaccttatccgagtttcagagaggaggtgcatggccgccgtcagctcgtaccgtgaggcgtcctgttaagtcaggcaacgagcgagacccgcatccttacttgccagcagcactgcgaagtggctggggacagtagggagaccgccgtggccaacacggaggaaggaacgggcaacggtaggtcagtatgccccgaatgtgctgggcaacacgcgggctacaatggtcgagacaaagggttccaactccgaaaggagacggtaatctcagaaactcgatcgtagttcggattgtgggctgcaactcgcccacatgaagctggattcggtagtaatcgcgtgtcacaagcgcgcggtgaatacgtccctgctccttgcacacaccgcccgtcaaagcacccgagtgaggtccggatgaggcgcgtcacacgcgtcgaatctgggcttcgcaagggggcttaagtcgtaacaaggtagccgtaggggaat

SEQ ID NO: 993 - DNA, 1506 bp, Helicobacter bilis
tttatggagagtttgatcctggctcagagtgaacgctggcggcgtgcctaatacatgcaagtcgaacgatgaagcttctagcttgctagaagtggattagtggcgcacgggtgagtaatgcataggttatgtgccctttagtctgggatagccactggaaacggtgattaatactggatactccctacgggggaaaggtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttaggattgtaaactccttttgttagagaagattatgacggtatctaacgaataagcaccggctaactccgtgccagcagccgcggtaatacggagggtgcaagcgttactcggaatcactgggcgtaaagagcgcgtaggcgggtggtcaagtcagatgtgaaatcctgtagcttaactacagaactgcatttgaaactgaccatctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgccctgcttgtcagggcagtaatgcagctaacgcattaagcattccgcctggggagtacggtcgcaagattaaaactcaaaggaatagacggggacccgcacaagcggtggagcatgtggtttaattcgaagctacgcgaagaaccttacctaggcttgacattgatagaatccgctagagatagtggagtgctggcttgccagagcttgaaaacaggtgctgcacggctgtcgtcagctcgtgtcgtgagatgttgggttaagtcccgcaacgagcgcaaccctcgtccttagttgctagcagctcggctgagcactctaaggagactgccttcgtaaggaggaggaaggtgaggacgacgtcaagtcatcatggcccttacgcctagggctacacacgtgctacaatgggacatacaaaaagatgcaataccgcgaggtggagcaaatctctaaaatgtctctcagttcggattgtagtctgcaactcgactacatgaagctggaatcgctagtaatcgtgaatcagccatgtcacggtgaatacgttcccgggtcttgtactcaccgcccgtcacaccatgggagttgtattcgccttaagtcgggatactaaattggttaccgcccacggcggatgcagcgactggggtgaagtcgtaacaaggtaaccgtaggtgaacctgcggttggatcacctcctttctagaga

SEQ ID NO: 994 - DNA, 1499 bp, Helicobacter canadensis
ttctatggagagtttgatcctggctcagagtgaacgctggcggcgtgcctaatacatgcaagtcgaacgatgaagcttctagcttgctagaagtggattagtggcgcacgggtgagtaatgcataggttatgtgccctttagtctgggatagccactggaaacggtgattaatactagatactccctacgggggaaagtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttcggattgtaaactccttttgttagagaagattatgacggtatctaacgaataagcaccggctaactccgtgccagcagccgcggtaatacggagggtgcaagcgttactcggaatcactgggcgtaaagagcgcgtaggcggggtagcaagtcagatgtgaaatcctatggcttaaccatagaactgcatttgaaactgttactctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgtgaggcttgtccttgcagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatctactagagatagtggagtgcccttttagggagcttgaaaacaggtgctgcacggctgtcgtcagctcgtgtcgtgagatgttgggttaagtcccgcaacgagcgcaaccctcgtccttagttgctagcagtttggctgagcactctaaggagactgccttcgtaaggaggaggaaggtgaggatgacgtcaagtcatcatggcccttacgcctagggctacacacgtgctacaatggggtgcacaaagagaagcaatactgcgaagtggagccaatctctaaaacatctctcagttcggattgtagtctgcaactcgactacatgaagctggaatcgctagtaatcgtgaatcagccatgtcacggtgaatacgttcccgggtcttgtactcaccgcccgtcacaccatgggagttgtattcgccttaagtcggaatactaaactagttaccgcccacggcggatgcagcgactggggtgaagtcgtaacaaggtaaccgtaggtgaacctgcggttggatcacctcctttc

SEQ ID NO: 995 - DNA, 1502 bp, Helicobacter cinaedi
ttttatggagagtttgatcctggctcagagtgaacgctggcggcgtgcctaatacatgcaagtcgaacgatgaagcttttagcttgctagaagtggattagtggcgcacgggtgagtaatgcataggttatgtgccctttagtctgggatagccactggaaacggtgattaatactggatactccctacgggggaaaggtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttaggattgtaaactccttttgtaagagaagattatgacggtatcttacgaataagcaccggctaactccgtgccagcagccgcggtaatacggagggtgcaagcgttactcggaatcactgggcgtaaagagtgcgtaggcgggtagtcaagtcagatgtgaaatcctgtagcttaactacagaactgcatttgaaactgactatctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgccctgcttgtcagggcagtaatgcagctaacgcattaagcattccgcctggggagtacggtcgcaagattaaaactcaaaggaatagacggggacccgcacaagcggtggagcatgtggtttaattcgagtatacgcgaagaaccttacctaggcttgacattgatagaatccgctagagatagtggagtgttggcttgccagagcttgaaaacaggtgctgcacggctgtcgtcagctcgtgtcgtgagatgttgggttaagtcccgcaacgagcgcaaccctcgtccttagttgctagcagctcggctgagcactctaaggagactgccttcgtaaggaggaggaaggtgaggacgacgtcaagtcatcatggcccttacgcctagggctacacacgtgctacaatgggacatacaaaaagatgcaatatcgcgagatggagcaaatctctaaaatgtctctcagttcggattgtagtctgcaactcgactacataaagctggaatcgctagtaatcgcaaatcagcaatgttgcggtgaatacgttcccgggtcttgtactcaccgcccgtcacaccatgggagttgtattcgccttaagtcgggatactaaattggttaccgcccacggcggatgcagcgactggggtgaagtcgtaacaaggtaaccgtaggtgaacctgcggttggatcacctcctttct

SEQ ID NO: 996 - DNA, 1508 bp, Helicobacter pullorum
ttttatggagagtttgatcctggctcagagtgaacgctggcggcgtgcctaatacatgcaagtcgaacgatgaagcttttagcttgctagaagtggattagtggcgcacgggtgagtaatgcataggttatgtgccctttagtctgggatagccactggaaacggtgattaatactagatactccctacgggggaaagtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttcggattgtaaactccttttgttagagaagataatgacggtatctaacgaataagcaccggctaactccgtgccagcagccgcggtaatacggagggtgcaagcgttactcggaatcactgggcgtaaagagcgcgtaggcggggtagtaagtcagatgtgaaatcctatggcttaaccatagaactgcatttgaaactactactctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgtgaggcttgtccttgcagtaatgcagctaacgcattaagcattccgcctggggagtacggtcgcaagattaaaactcaaaggaatagacggggacccgcacaagcggtggagcatgtggtttaattcgatgatacgcgaagaaccttacctaggcttgacattgatagaatctgctagagatagcggagtgctggcttgccagagcttgaaaacaggtgctgcacggctgtcgtcagctcgtgtcgtgagatgttgggttaagtcccgcaacgagcgcaaccctcgtccttagttgctagcagttcggctgagcactctaaggagactgccttcgtaaggaggaggaaggtgaggatgacgtcaagtcatcatggcccttacgcctagggctacacacgtgctacaatggggtgtacaaagagaagcaatactgcgaagtggagccaatctctaaaacatctctcagttcggattgtagtctgcaactcgactacatgaagctggaatcgctagtaatcgcaaatcagccatgttgcggtgaatacgttcccgggtcttgtactcaccgcccgtcacaccatgggagttgtattcgccttaagtcggaatactaaactagttaccgcccacggcggatgcagcgactggggtgaagtcgtaacaaggtaaccgtaggtgaacctgcggttggatcacctcctttcaagagaaa

SEQ ID NO: 997 - DNA, 1550 bp, Helicobacter pylori
atcaaaaaacaaaagagctttaggacaaacacttttatggagagtttgatcctggctcagagtgaacgctggcggcgtgcctaatacatgcaagtcgaacgatgaagctttctagcttgctagaaggctgattagtggcgcacgggtgagtaacgcataggtcatgtgcctcttagtttgggatagccattggaaacgatgattaataccagatactccctacgggggaaagatttatcgctaagagatcagcctatgtcctatcagcttgttggtaaggtaatggcttaccaaggctatgacgggtatccggcctgagagggtgaacggacacactggaactgagacacggtccagactcctacgggaggcagcagtagggaatattgctcaatgggggaaaccctgaagcagcaacgccgcgtggaggatgaaggttttaggattgtaaactccttttgttagagaagataatgacggtatctaacgaataagcaccggctaactccgtgccagcagccgcggtaatacggagggtgcaagcgttactcggaatcactgggcgtaaagagcgcgtaggcgggatagtcagtcaggtgtgaaatcctatggcttaaccatagaactgcatttgaaactactattctagagtgtgggagaggtaggtggaattcttggtgtaggggtaaaatccgtagagatcaagaggaatactcattgcgaaggcgacctgctggaacattactgacgctgattgcgcgaaagcgtggggagcaaacaggattagataccctggtagtccacgccctaaacgatggatgctagttgttggagggcttagtctctccagtaatgcagctaacgcattaagcatcccgcctggggagtacggtcgcaagattaaaactcaaaggaatagacggggacccgcacaagcggtggagcatgtggtttaattcgaagatacacgaagaaccttacctaggcttgacattgagagaatccgctagaaatagtggagtgtctggcttgccagaccttgaaaacaggtgctgcacggctgtcgtcagctcgtgtcgtgagatgttgggttaagtcccgcaacgagcgcaaccccctttcttagttgctaacaggtcatgctgagaactctaaggatactgcctccgtaaggaggaggaaggtggggacgacgtcaagtcatcatggcccttacgcctagggctacacacgtgctacaatggggtgcacaaagagaagcaatactgcgaagtggagccaatcttcaaaacatctctcagttcggattgtaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaattggctactgcccacggcacacacagcgactggggtgaagtcgtaacaaggtaaccgtaggtgaacctgcggttggatcacctcctttctagagaaaagc

SEQ ID NO: 998 - DNA, 1456 bp, Helicobacter sp.
  None
tagtgaacgctggcggcgtgcctaatacatgcaagtcgaacgatgaagcttttagcttgctagaagtggattagtggcgcacgggtgagtaatgcataggttatgtgccctttagtctgggatagccactggaaacggtgattaatactggatactccctgcgggggaaaggtttttcgctagaggatcagcctatgtcctatcagcttgttggtgaggtaatggctcaccaagactatgacgggtatccggcctgagagggtgatcggacacactggaactgagacacggtccagactcctacgggaggcagcagtagggaatattgctcaatgggggaaaccctgaagcagcaacgccgcgtggaggatgaaggttttaggattgtaaactccttttgtaagagaagattatgacggtatcttacgaataagcaccggctaactccgtgccagcagccgcggtaatacggagggtgtaagcgttactcggaatcactgggcgtaaagagtgcgtaggcgggtagtcaagtcagatgtgaaatcctgtagcttaactacagaactgcatttgaaactgactatctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgccctgcttgtcagggcagtaatgcagctaacgcattaagcattccgcctggggagtacggtcgcaagattaaaactcaaaggaatagacggggacccgcacaagcggtggagcatgtggtttaattcgaagctacgcgaagaaccttacctaggcttgacattgatagaatctgctagagatagcggagtgctggcttgccagagcttgaaaacaggtgctgcacggctgtcgtcagctcgtgtcgtgagatgttgggttaagtcccgcaacgagcgcaaccctcgtccttagttgttagcagctcggctgagcactctaaggagactgccttcgcaaggaggaggaaggtgaggacgacgtcaagtcatcatggcccttacgcctagggctacacacgtgctacaatgggacatacaaaaagatgcaatatcgcgagatggagcaaatctctaaaatgtctctcagttcggattgtagtctgcaactcgactacataaagctggaatcgctagtaatcgcaaatcagcaatgttgcggtgaatacgttcccgggtcttgtactcaccgcccgtcacaccatgggagttgtattcgccttaagtcgggatactaaattggttaccgcccacggcggatgcagcgactggggtgaagtcgtaacaaggtaaccgtgtcatagttgttt

SEQ ID NO: 999 - DNA, 1507 bp, Helicobacter winghamensis
ttttatggagagtttgatcctggctcagagtgaacgctggcggcgtgcctaatacatgcaagtcgaacgatgaagcttctagcttgctagaagtggattagtggcgcacgggtgagtaatgcataggttatgtgccctttagtctgggatagccactggaaacggtgattaataccggatattccctacgggggaaaggtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttcggattgtaaactccttttgttagagaagattatgacggtatctaacgaataagcaccggctaactccgtgccagcagccgcggtaatacggagggtgcaagcgttactcggaatcactgggcgtaaagagcgcgtaggcgggataataagtcagatgtgaaatcctatggcttaaccatagaactgcatttgaaactattattctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttggggtgcttgtcactccagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatccgctagagatagtggagtgctagcttgctagaacttgaaaacaggtgctgcacggctgtcgtcagctcgtgtcgtgagatgttgggttaagtcccgcaacgagcgcaaccctcgtccttagttgctaactattcggtagagcactctaaggagactgccttcgtaaggaggaggaaggtgaggatgacgtcaagtcatcatggcccttacgcctagggctacacacgtgctacaatggtatgtacaaagagaagcaataccgcgaggtggagcaaatctataaaacatatctcagttcggattgtagtctgcaactcgactacatgaagctggaatcgctagtaatcgcaaatcagcaatgttgcggtgaatacgttcccgggtcttgtactcaccgcccgtcacaccatgggagttgtattcgccttaagtcggaatgccaaactggctaccgcccacggcggatgcagcgactggggtgaagtcgtaacaaggtaaccgtaggtgaacctgcggttggatcacctcctttcaagaga

SEQ ID NO: 1000 - DNA, 1510 bp, Heliobacterium modesticaldum
gatcctggctcaggacgaacgctggcggcatgcctaacacatgcaagtcgaacggagagctgaagtttcgatggaggctcttagtggcggacgggtgagtaacgcgtggataacctgcctgagagtgggggataacagcccgaaagggctgctaataccgcataacgttgtccggggacatccccggataaccaaaggagcaatccgctgtcagatgggtccgcgtccgattagctagttggcggggtaagagcccaccaaggcaacgatcggtagccggcctgagagggtgaacggccacactgggactgagacacggcccagactcctacgggaggcagcagtggggaatcttccgcaatgggcgaaagcctgacggagcaatgccgcgtgggggacgaaggtcttcggattgtaaacccttgtcttcagggaagaagaatgacggtacctgaggaggaagccccggctaactacgtgccagcagccgcggtaatacgtagggggcgagcgttgtccggaattactgggcgtaaagcgcgtgcaggcggacctttaagtctgaggtgaaagaccggagctcaactccggggcggccttggaaactggaggtcttgagggatggagaggacagtggaattcccggtgtagcggtgaaatgcgtagatatcgggaggaaccccagtggcgaaggcgactgtctggacattacctgacgctgaggcgcgaaagcgtggggagcaaacaggattagataccctggtagtccacgccgtaaacgatgagtgctaggtgttgggggtatcgacccctccagtgccgcagtcaacacaataagcactccgcctggggagtacggccgcaaggttgaaactcaaaggaattgacgggggcccgcacaagcggtggagcatgtggtttaattcgacgcaacgcgaagaaccttaccaaggcttgacatcctccgaaccttgcagagatgcgagggtgcccttcggggagcggagagacaggtggtgcatggttgtcgtcagctcgtgtcgtgagatgttgggttaagtcccgcaacgagcgcaacccttatcctcagttgccagcgagagagacggggactctggggagactgcccgggacgaccgggaggaaggcggggatgacgtcaaatcatcatgccccttatgtcttgggctacacacgtgctacaatgggcggtacaaaccgaggcgaagccgcgaggcggagcgaaccggagaaagccgctcacagttcggattgctctctgcaactcgagagcatgaaggcggaatcgctagtaatcgcgggtcagcataccgcggtgaatacgttcccgggccttgtacacaccgcccgtcacaccacgaaagtcggcaacacccgaagtcggtgcgctaaccgcaaggaggcagccgccgaaggtggggtcgatgattggggtgaagtcgtaacaaggtagccgtatcggaaggtgcggctggatcacctcctttct

SEQ ID NO: 1001 - DNA, 1528 bp, Herbaspirillum seropedicae
agagtttgatcctggctcagattgaacgctggcggcatgccttacacatgcaagtcgaacggcagcataggagcttgctcctgatggcgagtggcgaacgggtgagtaatatatcggaacgtgccctagagtgggggataactagtcgaaagattagctaataccgcatacgatctacggatgaaagtgggggatcgcaagacctcatgctcctggagcggccgatatctgattagctagttggtggggtaaaagcctaccaaggcgacgatcagtagctggtctgagaggacgaccagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacggttttggctaatatccagaactaatgacggtacctgaagaataagcaccggctaactacgtgccagcagccgcggtaatacgtagggtgcaagcgttaatcggaattactgggcgtaaagcgtgcgcaggcggttgtgtaagacagatgtgaaatccccgggctcaacctgggaattgcatttgtgactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggtcggaatcctgaagagatttgggagtgctcgaaagagaaccggcgcacaggtgctgcatggctgtcgtcagctcgtgtcgtgagatgttgggttaagtccccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgaggggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttttaccagaagtgggtagcctaaccgtaaggagggcgctcaccacggtaggattcgtgactggggtgaagtcgtaacaaggtagccgtatcggaaggtgcggctggatcacctccttt

SEQ ID NO: 1002 - DNA, 1489 bp, Herbaspirillum sp.
  JC206
agagtttgatcctggctcagattgaacgctggcggcatgccttacacatgcaagtcgaacggcagcgcgggcttcggcctggcggcgagtggcgaacgggtgagtaatatatcggaacgtgccctagagtgggggataactagtcgaaagattagctaataccgcatacgatctacggatgaaagtgggggaccgcaaggcctcacgctcctggagcggccgatatctgattagctagttggtggggtaaaggcctaccaaggcgacgatcagtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtctgggaagaaatcccttgggctaatacctcgaggggatgacggtaccggaagaataagcaccggctaactacgtgccagcagccgcggtaatacgtagggtgcgagcgttaatcggaattactgggcgtaaagcgtgcgcaggcggttgtgcaagacagatgtgaaatccccgggcttaacctgggaactgcatttgtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggtcggaatcctccagagatgggggagtgcccgaaagggaaccgacgcacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgcagtctgcaactcgactgcatgaagttggaatcgctagtaatcgcggatcagcatgtcgcggtgaatacgttcccgggtcttgtacacaccgcccgtcacaccatgggagcgggttttaccagaagtgggtagcctaaccgcaaggagggcgcttaccacggtaggattcgtgactggggtgaagtcgtaacaaggta

SEQ ID NO: 1003 - DNA, 1361 bp, Histophilus somni
ctttctctgctgacgagtggcggacgggtgagtaaagcttgggaatctggcgaatggagggggatagccacgggaaactgtgggtaataccgcgtaaggtctaaggactaaaggggtgggactgagaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgataatcacagaagaagcaccggctaactccgtgccagcagccgcggtaatacggagggtgcgagcgttaatcggaatgactgggcgtaaagggcacgcaggtggtgacttaagtgaggtgtgaaatccccgggcttaacctgggaacagcatttcagactgggtgactagagtactttagggaggggtagaattccacgtgtagcggtgaaatgcgtagagatgtggaggaataccgaaggcgaaggcagccccttgggaagatactgacgctcgagtgcgaaagcgtggggagcaaacaggattagataccctggtagtccacgctgtaaacgatgtcgatttggggattgggtgaatacttggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagccgccagagatggtggtgtgcctacgggagcttagagacaggtgctgcatggctgtcgtcagctcgtgttgtgaaatgttgggttaagtcccgcaacgagcgcaacccttatcctttgttgccagcatgttagggtgggaactcaaaggagactgccggtgataaactggaggaaggtggggatgacgtcaagtcatcatggcccttacgagtagggctacacacgtgctacaatggcgtatacagagggaggcgagcctgcgagggtaagcgaagctcagaaagtacgtctaagtccggattggagtctggaactcgactccatgaagtcggaatcgctagtaatcgcggatcagaatgtcgcggtgaatacgttcccgggccttgtacacaccgcccgtcacaccatgggagtgggttgtaccagaagtagatagcttaa

SEQ ID NO: 1004 - DNA, 1332 bp, Holdemania filiformis
gcgaacgggtgagtaatacataagcaatctgcccatcggcctgggataacagttggaaacgactgctaataccggataggtgatgaagaggcatctctcgatcattaaagttgggatacaacacggatggatgagcttatggcgtattagctagtaggtgaggtaacggctcacctaggcgatgatacgtagccgacctgagagggtgaccggccacattgggactgagacacggcccaaactcctacgggaggcagcagtagggaattttcggcaatgggcgaaagcctgaccgagcaacgccgcgtgagtgaagaaggccttcgggttgtaaagctctgttgtgaaggaagaacggctcatacagggaatggtatgggagtgacggtactttaccagaaacccggctaactacgtgccacagccgcggtaatacgtaggtggcgagcgttatccggaattattgggcgtaaagggtgcgcaggcggtttgttaagtttaaggtgaaagcgtggggcttaaccccatatagtaaaactgacagactaagtacaggagagggcaatggaattccatgtgtagcggtaaaatgcgtagatatatggaggaacaccagtggcgaaggcggttgcctggcctgtaactgacgctcatgcacgaaagcgtggggagcaatagattaataccctatagtccacgccgtaaacgatgagaactaagtgttggggaaactcatgctgcagttaacgcaataagttctccgcctggggagtatgcacgcaagtgtgaaactcagaggaattgacgggggcccgcacaagcggtggagtatgtggtttaattcgacgcaacgcgaagaaccttaccaggtcttgacatcccctgcaaagacatagagatatgttggaggttatcagggagacaggtggtgcatggttgtcgtcagctcgtgtcgtgagatgttgggttaagtcccgcaacgagcgcaacccttgtctttagttgctaacattaagttgaggactctagagagactgccggtgacaaaccggaggaaggtggggatgacgtcaaatcatcatgccccttatgacctgggctacacacgtactacaatggcggatacaacgagaagcaagacagtgatgtggagcaaaactcagaaagtccgtctcagttcggattgaagtctgcaacccgacttcatgaagccggaatcgctagtaatcgcggatcagcatgccgcggtgaatacgttctcgggccttgtacacaccgcccgtcaaaccatgagagttggcaatacccgaagccggtggcctaacctcgcaa

SEQ ID NO: 1005 - DNA, 1510 bp, Hydrogenoanaerobacterium saccharovorans
gagtttgatcatggctcaggacgaacgctggcggcgcgcctaacacatgcaagtcgaacggaactgttcggatgaagttttcggatggatgaagaacagtttagtggcggacgggtgagtaacacgtgagcaacctgcctttcagaggggaataacattcggaaacgaatgctaataccgcataatgcaacgagatggcatcatcttgctgccaaagatttatcgctgaaagatgggctcgcgcccgattagctagttggtgaggtaatggcccaccaaggcaacgatcggtagccggactgagaggttgatcggccacattgggactgagacacggcccagactcctacgggaggcagcagtgggggatattgcacaatgggcgaaagcctgatgcagcgacgccgcgtgagggaagacggttttcggattgtaaacctctgtcttcagggacgataatgacggtacctgaggaggaagcaccggctaactacgtgccagcagccgcggtaatacgtagggtgcaagcgttgtccggaattactgggtgtaaagggagcgtaggcgggattgtaagttggatgtgtaatgtaccggctcaaccggtaacttgcattcaaaactgcagttcttgagtgaagtagaggcaggcggaattcctagtgtagcggtgaaatgcgtagatattaggaggaacaccagtggcgaaggcggcctgctgggcttttactgacgctgaggctcgaaagcatgggtagcaaacaggattagataccctggtagtccatgccgtaaacgatgattactaggtgtgggtgtgcaagcatccgtgccgcagctaacgcaataagtaatccacctggggagtacggccgcaaggctgaaactcaaaggaattgacgggggcccgcacaagcagtggattatgtggtttaattcgaagcaacgcgaagaaccttaccaggtcttgacatcccttgcataccatagagatatgggaagcccttcggggcaaggagacaggtggtgcatggttgtcgtcagctcgtgtcgtgagatgttgggttaagtcccgcaacgagcgcaacccttactattagttgctacgcaagagcactctaataggactgccgttgacaaaacggaggaaggtggggatgacgtcaaatcatcatgccccttatgacctgggctacacacgtaatacaatgacgataaacagagggtagcgaagccgcgaggtggagccaatccccaaaagtcgtctcagttcggattgcaggctgcaactcgcctgcatgaagtcggaattgctagtaatcgcaggtcagcatactgcggtgaatacgttcccgggccttgtacacaccgcccgtcacaccatgggagtcggtaacacccgaagccagtagtctaaccgcaaggaggacgctgccgaaggtgggattgatgactggggtgaagtcgtaacaaggtagccgtatcggaaggtgcggctggatcacctcct

SEQ ID NO: 1006 - DNA, 1507 bp, Hyperthermus butylicus
actccggttgatcctgccggacccgaccgctatcggggtgggactaagccatgggagtcgtgcgcccccggatgcgggggcgcggcggacggctgagtaacacgtggctaacctaccctcgggacggggataaccccgggaaactggggctaatccccgataggcgagggggcctggaacgggtccctcgccgaaagggcgcgcggagcttccccgcgcgccgcccgaggatggggctgcggcccatcaggtagttggcggggtaacggcccgccaagccgataacgggtaggggccgtgggagcgggaccccccagatgggcactgagacaagggcccaggccctacggggcgcaccaggcgcgaaacctccgcaatgcgggcaaccgtgacggggtcaccccgagtgccgccgataaggcggctgttccccgctgtaagaaggcgggggagtaagcggggggcaagtctggtgtcagccgccgcggtaataccagccccgcgagcggtcgggatgcttactgggcctaaagcgcccgtagccggcccggtaagtccccccctaaagccccgggctcaacccggggagtgggggggatactaccgggctagggggcgggagaggccgagggtactcccggggtaggggcgaaatccgataatcccgggaggaccaccagtggcgaaggcgctcggctggaacgcgcccgacggtgaggggcgaaagccgggggagcaaaccggattagatacccgggtagtcccggctgtaaacgatgcgggctaggtgttgggcgggcttggagcccgcccagtgccgcagggaagccgttaagcccgccgcctggggagtacggccgcaaggctgaaacttaaaggaattggcgggggagcaccacaaggggtggagcctgcggcttaattggagtcaacgccgggaatcttaccgggggcgacagcaggatgacggccaggctgacgaccttgcccgacgcgctgagaggaggtgcatggccgtcgccagctcgtgccgtgaggtgtccggttaagtccggcaacgagcgagacccccacccctagttgctaccccgggggccaccccgggggcacactagggggactgccgccgtccaaggcggaggaaggagggggccacggcaggtcagcatgccccgaatcccccgggctgcacgcgggctacaatggcggggacagcgggatccgaccccgaaagggggaggcaatcccttaaaccccgccgcagttgggatcgagggctgcaactcgccctcgtgaacgcggaatccctagtaaccgcgcgttagcatcgcgcggtgaatacgtccctgctccttgcacacaccgcccgtcgctccacccgagcgggggaggggtgaggccctgcccctgggggcaaccccgggggtggggtcgaacccctcccccgcgaggggggagaagtcgtaacaaggtagccgtaggggaacctgcggctggatcacctcct

SEQ ID NO: 1007 - DNA, 1333 bp, Hyphomicrobium sulfonivorans
gagtttgatcctggctcagaacgaacgatggcggcaggcctaacacatgcaagtcgaacgagtggcagacgggtgagtaacgcgcgggaaccttcccaatggtgcggaatagcccagggaaacttggagtaataccgcataaggaaagtcgccattggatgggcccgcgtcgattagctagttggtagggtaacggcctaccaaggcgacgatccgtagctggtttgagagaatgaccagccacactgggactgagacacggcccagactcctacgggaggcagcagtggggaatcttggacaatgggcgcaagcctgatccagccatgccgcgtgagtgacgaaggccttagggttgtaaagctcttttgccggggacgatgacggtacccggagaataagtcccggctaacttcgtgccagcagccgcggtaatacgaaggggactagcgttgttcggaattactgggcgtaaagcgcacgtaggcggattattaagtcaggggtgaaatcccggggctcaacctcggaactgcctttgatactggtaatctagagtccgatagaggtgggtggaattcctagtgtagaggtgaaattcgtagatattaggaagaacaccagtggcgaaggcggcccactggatcgactgacgctgaggtgcgaaagcgtggggagcaaacaggattagataccctggtagtccacgccgtaaacgatggatgctagccgtcggcatgtcggtggcgcagctaacgcattaagcatcccgcctggggagtacggccgcaaggttaaaactcaaaggaattgacgggggcccgcacaagcggtggagcatgtggtttaattcgacgcaacgcgaagaaccttaccagctcttgacatgcacaggtgctgcatggctgtcgtcagctcgtgtcgtgagatgttgggttaagtcccgcaacgagcgcaaccctcgccattagttgccatcatgggcactctagtgggactgccggtgataagccggaggaaggtggggatgacgtcaagtcatcatggcccttacgggctgggctacacacgtgctacaatggcggtcagtgggcagcaacacagcgatgtgaagctaatctcagccgtctcagttcggatggtctctgcaactcgagaccagaagttggaatcgctagtaatcgcggatcagcatgccgcggtgaatacgttcccgggccttgtacacaccgcccgtcacaccatgggagttggttctacccgaaggcgatcgctaggcagtcgaccacggtagggtcagcgactggggtgaagtcgtaacaaggtaaccgta

SEQ ID NO: 1008 - DNA, 1448 bp, Hyphomonas neptunium
agagtttgattctggctcagaacgaacgctggcggcaggcctaacacatgcaagtcgaacgatatagtggcagacgggtgagtaacgcgtgggaacgtacctttcactacggaatagctctgggaaactggtggtaataccgtatacgcccttagggggaaagatttatcggtgaaagatcggcccgcgttggattagctagttggtgaggtaatggctcacaaaggcgacgatccatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgtcagggatgataatgaccgtacctgaagaagaagccccggctaacttcgtgccagcagccgcggtaatacgaagggggctagcgttgttcggaattactgggcgtaaagcgcacgtaggcggacttttaagtcaggtgtgaaatcccgaggctcaacctcggaactgcatttgaaactggaagtctggagatcaggagaggttagcggaataccgagtgtagaggtgaaattcgtagatattcggtggaacaccagtggcgaaggcggctaactggactgatactgacgctgaggtgcgaaagtgtggggagcaaacaggattagataccctggtagtccacaccgtaaacgatgagagctagttgttggcaggcatgcctgtcggtgacgcagttaacacattaagctctccgcctggggagtacggccgcaaggttaaaactcaaagaaattgacgggggcccgcacaagcggtggagcatgtggtttaattcgaagcaacgcgcagaaccttacctacccttgacatgtctagtatggtttccggagacggattccttcagttcggctggctagaacacaggtgctgcatggctgtcgtcagctcgtgtcgtgagatgttgggttaagtcccgcaacgagcgcaaccctcatccttagttgccatcacgtttgggtgggcactctaaggaaactgccggtggcaagccggaggaaggtggggatgacgtcaagtcctcatggcccttacgggtagggctacacacgtgctacaatggcagtgacaatgggataatcccaaaaagctgtctcagttcggattgtcgtctgcaactcgacggcatgaaggtggaatcgctagtaatcgtggatcagcatgccacggtgaatacgttcccgggccttgtacacaccgcccgtcacatcatgggaattggttctacccgaagatcgtgcgctaacttcggaggcagcgagccacggtaggatcagtaactgggatgaagtcgtaacaaggtagccgtaggggaacctgcggctggatcacctccttt

SEQ ID NO: 1009 - DNA, 1287 bp, Ignatzschineria indica
ttaacacatgcaagtcgaacgagtggcggacgggtgagtaatgcataggaatctaccttttagtctaggataactacccgaaagggtggctaatactggatgtgtaaaggcgctaagagatgagcctatgtgggattagctagttggtgaggtaacggctcaccaaggcgacgatctctagctggtttgagaggatgatcagccacactgggactgagacacggcccagactcctacgggaggcagcagtggggaatattggacaatgggcgaaagcctgatccagcaataccgcgtgtgtgaagaaggccctagggttgtaaagcacttttgttagggagaatgatgttacctaaagaataagcaccggctaactccgtgccagcagccgcggtaatacggagggtgcaagcgttaatcggaattactgggcgtaaagggcgcgtaggtggtatcttaagttgggtgtgaaatccccgggctcaacctgggaattgcatccaaaactggggtgctagagtgtggtagagggtagcggaatttctggtgtagcggtgaaatgcgtagatatcagaaggaacatcaatggcgaaggcagctacctgggccaactgacgctgaggcgcgaaagcgtggggagcaaacaggattagataccctggtagtccacgctataaacgatgacaacttgttgatggggcttcgttgacggagctaacgcgttaagttgtccgcctggggagtacggtcgcaaggctgaaactcaaaggaattgacggggacccgcacaagcggtggagcatgtggtttaattcgatgcaacgcgaagaaccttacctggtcttgacatcgacaggtgctgcatggctgtcgtcagctcgtgtcgtgagatgttcggttaagtccggcaacgagcgcaacccttgtccttatttgccagcacgtgggaactctaaggagactgccggtgataaaccggaggaaggtagggacgacgtcaagtcatcatggcccttatgaccagggctacacacgtgctacaatggtcggcaatgggttgccaaaccgcgaggtggagctaatcccacccgatcccagtccggatgtagtctgcaactcgactacagaagtcggaatcgctagtaatcgtggatcagaatgccacggtgaatacgttcccgggtcttgtacacaccgcccgtcacaccatggaagttgattgctccagaagtaggtgcttagggcgcttaccacggagtggtcgatgactggggtgaagtcgtaaca

SEQ ID NO: 1010 - DNA, 1317 bp, Ignatzschineria sp.
  NML 95-0260
acgctggcggtatgcttaacacatgcaagtcgaacgagtggcggacgggtgagtaatgcataggaatctaccttttagtctaggataactacccgaaagggtggctaatactggatgtgtaaaggcgctaagagatgagcctatgtgggattagctagttggtgaggtaatggctcaccaaggcgacgatctctagctggtttgagaggatgatcagccacactgggactgagacacggcccagactcctacgggaggcagcagtggggaatattggacaatgggcgcaagcctgatccagcaataccgcgtgtgtgaagaaggccctagggttgtaaagcacttttgttagggagaatgatgttacctaaagaataagcaccggctaactccgtgccagcagccgcggtaatacggagggtgcaagcgttaatcggaattactgggcgtaaagggcgcgtaggtggtactttaagttgggtgtgaaatccccgggctcaacctgggaattgcatccaaaactggggtgctagagtgtggtagagggtagcggaatttctggtgtagcggtgaaatgcgtagatatcagaaggaacatcaatggcgaaggcagctacctgggccaactgacgctgaggcgcgaaagcgtggggagcaaacaggattagataccctggtagtccacgctgtaaacgatgacaacttgttgatggggcttcgttgacggagctaacgcgttaagttgtccgcctggggagtacggtcgcaaggctgaaactcaaaggaattgacggggacccgcacaagcggtggagcatgtggtttaattcgatgcaacgcgaagaaccttacctggtcttgacatcgacaggtgctgcatggctgtcgtcagctcgtgtcgtgagatgttcggttaagtccggcaacgagcgcaacccttgtccttatttgccagcacgtgggaactctaaggagactgccggtgataaaccggaggaaggtagggacgacgtcaagtcatcatggcccttatgaccagggctacacacgtgctacaatggtcggcaatgggttgccaagccgcgaggtggagctaatctcatccgatcccagtccggatgtagtctgcaactcgactacagaagtcggaatcgctagtaatcgtggatcagaatgccacggtgaatacgttcccgggtcttgtacacaccgcccgtcacaccatggaagttgattgctccagaagtaggtgcttagggcgcttaccacggagtggtcgatgactggggtgaagtcgtaacaaggtagccgtagggg

SEQ ID NO: 1011 - DNA, 1469 bp, Ignicoccus islandicus
  modified_base (1377)..(1380): a, c, t, g, unknown or other
cggacccgaccgctatcggggtaaggctaagccatgggagtcgaacgcccgccgccgcgggcgtggcggacggctgagtaacacgtggctaacctaccctcgggagggggataacaccgggaaactggtgctaatcccccataggggcggtggcctggaagggtaccgccccgaaagggggaggcgggggttatcgccgcctctccgcccgaggatgcggctgcgccctatcaggtagttggcggggtaacggcccgccaagcctaagacgggtaggggccgtgggagcgggagcccccagatgggcactgagacaagggcccaggccctacggggcgcaccaggcgcgaaaactcgccaatgcgggcaaccgtgacggggttaccccgagtgcccccattacgggggcttttccccgctgtaaacaggcgggggtaataagcggggggcaagtctggtgtcagccgccgcggtaataccagccccgcgagtggtcgggacgtttattgggcctaaagcgcccgtagccggcctggtaggtcccctcctaaaacccggggctcaaccccgggggtggaggggaaaccaccaggctagggggcgggagaggccgagggtactcccggggtaggggcgaaatccgataatcccgggaggaccgccagtggcgaaggcgctcggctggaacgcgcccgacggtgaggggcgaaagccgggggagcgaaccggattagataccgggtagtcccggctgtaaacgatgcgggctaggtgttgggtgggcttcgagcccgcccagtgccgcagggaagccgttaagcccgccgcctggggagtacggccgcaaggctgaaacttaaaggaattggcgggggagcaccacaaggggtggcaggtgcggcttaattggagtcaacgccgggaacctcaccgggggcgacagcaggatgaaggtcaggctgaagaccttacctgacgcgctgagaggaggtgcatggccgtcgccagctcgtgccgtgaggtgtccggttaagtccggcaacgagcgagacccccacccctacttgctacccggggctccggccccggggcacagtagggggactgccgccgtataaggcggaggaaggagggggctatggcaggtcagcatgccccgaaacccccgggctgcacgcgggctacaatggcggggacagcgggttgcgaccccgaaagggggagcaaatccctcaaaccccgccgaggttgggatcgagggctgcaactcgccctcgtgaacgcggaatccctagtaaccgcacgttagcatcgtgcggtgaacacgtccctgctccttgcacacaccgcccgtcgctccacccgaggggacgggtnnnnaggcccccgtagggaaactcccgggtatcctcgaactccctcctctcgaggggggagaagtcgtaacaaggtagccgtaggggaacctg

SEQ ID NO: 1012 - DNA, 1414 bp, Inquilinus limosus
ttgaatcctggctcagaacgaacgctggcggcaggcctaacacatgcaagtcgaacgccccgcaaggggagtggcgcacgggtgagtaacacgtgggaacctaccttctggtacggaacaaccaagggaaactttggctaataccgtatacgacctccgggtgaaagatttatctgccggaagaggggccccgcgtccgattaggtagttggtggggtaaccggcctaccaagccgacgatcggtagctggtctgagaggatgaccagccacactgggactgagacacggcccagactcctacgggaggcagcagtggggaatattggacaatgggcgcaagcctgatccagccatgccgcgtgagtgatgaaggccttcgggttgtaaagctctttcacccacgacgatgatgacggtagtgggagaagaagccccggctaacttcgtgccagcagccgcggtaatacgaagggggcaagcgttgttcggaatgactgggcgtaaagggcgcgtaggcggttcgttgcgtcagatgtgaaagccccgggctcaacctgggaactgcatttgatacgggcgggcttgaatccaagagagggtggtggaattcccagtgtagaggtgaaattcgtagatattgggaagaacaccagtggcgaaggcggccacctggcttggcattgacgctgaggcgcgaaagcgtggggagcaaacaggattagataccctggtagtccacgccgtaaacgatgtgtgctagccgtcgggcagcttgctgttcggtggcgcagctaacgcgataagcacaccgcctggggagtacggtcgcaagattaaaactcaaaggaattgacgggggcccgcacaagcggtggagcatgtggtttaattcgaagcaacgcgcagaaccttaccaacccttgacatggggagtgtgggcctgagagatcgggtccgggtccttcagttcggctggctcccacacaggtgctgcatggctgtcgtcagctcgtgtcgtgagatgttgggttaagtcccgcaacgagcgcaaccctcctcttcagttgccatcattgagttgggcactctggagatactgccggtgacaagccggaggaaggcggggatgacgtcaagtcctcatggcccttacgggttgggctacacacgtgctacaatggcggtgacagtgggcagcgaaggggcgacctggagctaatccccaaaagccgtctcagttcggattgcactctgcaactcgggtgcatgaagttggaatcgctagtaatcgcggatcagcacgccgcggtgaatacgttcccgggccttgtacacaccgcccgtcacaccatgggagttggttttacccgaagacggtgcgctgacccgcaagggaggcagccggccacggt

SEQ ID NO: 1013 - DNA, 1473 bp, Janibacter limosus
gacgaacgctggcggcgtgcttaacacatgcaagtcgaacggtgaagctccagcttgctggagtggatcagtggcgaacgggtgagtaacacgtgagcaacctgccccagactctggaataagcgctggaaacggcgtctaatactggatacgagaccaacctgcatgggtatggtctggaaagtttttcggtttgggatgggctcgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcaccggctaactacgtgccagcagccgcggtaatacgtagggtgcgagcgttgtccggaattattgggcgtaaagagcttgtaggcggtttgtcgcgtctgctgtgaaaatccggggctcaaccccggacttgcagtgggtacgggcagactagagtgtggtaggggagactggaattcctggtgtagcggtgaaatgcgcagatatcaggaggaacaccgatggcgaaggcaggtctctgggccactactgacgctgagaagcgaaagcatggggagcgaacaggattagataccctggtagtccatgccgtaaacgttgggaactaggtgtgggtctcattccacgagatccgtgccgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagagatggttgccccttttaggtcggtatacaggtggtgcatggttgtcgtcagctcgtgtcgtgagatgttgggttaagtcccgcaacgagcgcaaccctcgttctatgttgccagcacgtaatggtggggactcatggaagactgccggggtcaactcggaggaaggtggggatgacgtcaaatcatcatgccccttatgtcttgggcttcacgcatgctacaatggccggtacaaagggctgcgaaaccgcaaggtggagcgaatcccaaaaaaccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaaggtgggactggcgattgggactaagtcgtaacaaggtagccgtaccggaa

SEQ ID NO: 1014 - DNA, 1389 bp, Janibacter melonis
cgaacggtgaactttggagcttgctctaaggggatcagtggcgaacgggtgagtaacacgtgagtaacctgccccggactctggaataagcgctggaaacggcgtctaataccggatacgagacgcaaccgcatggttagtgtctggaaagtttttcggtctgggatggactcgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcaccggctaactacgtgccagcagccgcggtaatacgtagggtgcgagcgttgtccggaattattgggcgtaaagagcttgtaggcggtttgtcgcgtctgctgtgaaaatccggggctcaaccccggacttgcagtgggtacgggcagactagagtgtggtaggggagactggaattcctggtgtagcggtgaaatgcgcagatatcaggaggaacaccgatggcgaaggcaggtctctgggccactactgacgctgagaagcgaaagcatggggagcgaacaggattagataccctggtagtccatgccgtaaacgttgggcgctaggtgtgggactcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatataccggaaacatccagagatgggtgccccttttggtcggtatacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacaaagggctgcgataccgcaaggtggagcgaatcccaaaaaaccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaa

SEQ ID NO: 1015 - DNA, 1496 bp, Janthinobacterium sp.
  SY12
tagagtttgatcatggctcagattgaacgctggcggcatgccttacacatgcaagtcgaacggcagcacggagcttgctctggtggcgagtggcgaacgggtgagtaatatatcggaacgtaccctggagtgggggataacgtagcgaaagttacgctaataccgcatacgatctacggatgaaagtgggggatcgcaagacctcatgctcgtggagcggccgatatctgattagctagttggtagggtaaaagcctaccaaggcatcgatcagtagctggtctgagaggacgaccagccacactggaactgagacacggtccagactcctacgggaggcagcagtggggaattttggacaatgggcgaaagcctgatccagcaatgccgcgtgagtgaagaaggccttcgggttgtaaagctcttttgtcagggaagaaacggtgagggctaatatcccttgctaatgacggtacctgaagaataagcaccggctaactacgtgccagcagccgcggtaatacgtagggtgcaagcgttaatcggaattactgggcgtaaagcgtgcgcaggcggctttgtaagtctgatgtgaaatccccgggctcaacctgggaattgcattggagactgcaaggctagaatctggcagaggggggtagaattccacgtgtagcagtgaaatgcgtagatatgtggaggaacaccgatggcgaaggcagccccctgggtcaagattgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggctggaatccctgagagattggggagtgctcgaaagagaaccagtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttacgggtagggcttcacacgtcatacaatggtacatacagagcgccgccaacccgcgagggggagctaatcgcagaaagtgtatcgtagtccggattgtagtctgcaactcgactgcatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgta

SEQ ID NO: 1016 - DNA, 1478 bp, Johnsonella ignava
  modified_base (37)..(37): a, c, t, g, unknown or other
  modified_base (86)..(86): a, c, t, g, unknown or other
  modified_base (408)..(408): a, c, t, g, unknown or other
  modified_base (452)..(452): a, c, t, g, unknown or other
  modified_base (477)..(477): a, c, t, g, unknown or other
  modified_base (480)..(480): a, c, t, g, unknown or other
  modified_base (1338)..(1338): a, c, t, g, unknown or other
tgaacgctggcggcgtgcttaacacatgcaagtcgancggagactttttcagtgcaaccttcggggagcaagagaagtcttagtgncggacgggtgagtaacgcgtgggcaacctgcctcgcaccgtgggataacagggggaagctcctgctaataccgcataaagtatatagacgcatgtcaatatacaaaaagggataccggtgagagatgggcccgcgtccgattagatagttggcaggatagcagcctaccaagtcaacgatcggtagccggcttgagagagtggacggccacactgggactgagacacggcccagactcctacgggaggcagcagtggggaatattggacaatgggggcaaccctgatccagcgacgccgcgtgagtgaagaagtatctcggnacgtaaagctctatcagcagggaagaaaaaagacggtacctgantaagaagccccggctaactacgtgncancagccgcggtaatacgtagggggcaagcgttatccggaattactgggtgtaaagggagcgtagacggctatgcaagtctggagtgaaatgccggggctcaaccccggagctgctctggaaactgcgtggcttgagtgtcggaggggcaggcggaattcccagtgtagcggtgaaatgcgtagatattgggaggaacaccggcggcgaaggcggcctgctggacgacaactgacgttgaggctcgaaggcgtgggtagcaaacaggattagataccctggtagtccacgcagtaaacgatgaatactaggtgtcggggagttaaatttccggtgccggcgcaaacgcaataagtattccacctggggagtacgttcgcaagaatgaaactcaaaggaattgacggggacccgcacaagcggtggagcatgtggtttaattcgaagcaacgcgaagaaccttaccaagccttgacatgccggtgaagggggagtaaaatcctctgccccttggggcaccggacacaggtggtgcatggttgtcgtcagctcgtgtcgtgagatgttgggttaagtcccgcaacgagcgcaaccctcattcccggtagccagcagtaagatggggactccggggagactgccgaggaagactcggaggaaggcggggatgacgtcaaatcatcatgccccttatggtttgggctacacacgtgctacaatggcgcagacagagggaagcaaggccgcgaggcagagcaaatctcaaaaactgcgtctcagttcggattgcaggctgcaactcgcctgcatgaagccggaatcgctagtaatcgcagatcagaatgctgcggtgaatacgtncccgggtcttgtacacaccgcccgtcacaccatgggagtcggcaatgcccgaagtcagtggcccaaccgtaaggagggagctgccgaaggcagggcggatgaccggggtgaagtcgtaacaaggtagccgtatcggaagg

SEQ ID NO: 1017 - DNA, 1523 bp, Jonquetella anthropi
gagagtttgatcctggctcaggataaacgctggcggcgtgcttaacacatgcaagttggacgggaatactcgaggaagagacttcggttaattttttgggtatgagagtagcggacgggtgagtaatgcataagaatctatccatcagagggggacaactgcgggaaaccggagctaataccccgtaagccggaaggtgaaagggagcaatccgctgatggaggagcttgtgtcctatcaggtagttggtgaggtaagagctcaccaagccgaagacgggtagccgggctgagaggttgtacggccacattggaactgagagacggtccagactcctacgggaggcagcagtggggaatattgggcaatgggcgaaagcctgacccagcgacgccgcgtgagggaagacggccttcgggttgtaaacctctgttgcaggggaagaaggaagtgacggtaccctgcgaggaagctccggcaaactacgtgccagcagccgcggtaatacgtagggagcgagcgttatccggaattactgggcgtaaagggcgcgtaggcggaatgacaagtcagcaagtgaaagcgtggggctcaaccccatgatgcggctgaaactgttattctagaggcatggagaggcaaacggaattcccggtgtagcggtgaaatgcgtagatatcgggaagaacaccagtggcgaaggcggtttgctggccatgaactgacgctcatagcgcgaaagctagggtagcaaacgggattagataccccggtagtcctagcagtaaacgatgtatgctgggtgtgggtgtagcgatacatccgtgccgaagttaacgcgataagcataccgcctggggagtacggtcgcaagattgaaactcaaaggaattgacgggggcccgcacaagcggtggagcacgtggtttaattcgatgcaaaccgaagaaccttacctgggcttgacatgtaaggaaaggtgtatggagacgtacaagtgtactgcttcggtagtacgccttacacaggtgctgcatggctgtcgtcagctcgtgtcgtgagatgttgggttaagtcccgcaacgagcgcaacccctattgccagttgctaacaggtagagctgagcactcaggcgagactgccgccgacaaggtggaggaaggtggggatgacgtcaagtcatcatggcccttatgcccagggccacacacatgctacaatggccggtacaaagggaagcgaggctgcgaagcggagcgaaccccaaaagccggtcccagttcggattgcagtctgcaactcgactgcatgaagttggaatcgctagtaatcgcgaatcagcgaagtcgcggtgaatacgttcccgggccttgtacacaccgcccgtcacaccatccgagttggatgcactccaagtcggtatctcaaccgcaaggggggagccgcccaaagtgtgtctggtgaggagggtgaagtcgtaacaaggtagccgtaccggaaggtgcggctggatcacctcctt

SEQ ID NO: 1018 - DNA, 1414 bp, Kerstersia gyiorum
gcgggatgctttacacatgcaagtcgaacggcagcacgaggagcttgctccttggtggcgagtggcgaacgggtgagtaatatatcggaacatgcccagtagcgggggataactactcgaaagagtggctaataccgcatacgtcctacgggagaaagcaggggaccttcgggccttgcactattggagtggccgagatcggattagctagttggtggggtaaaggcctaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttgtcaggaaagaaatcgcccgggataatacctcgggtggatgacggtacctgaagaataagcaccggctaactacgtgccagcagccgcggtaatacgtagggtgcaagcgttaatcggaattactgggcgtaaagcgtgcgcaggcggttcggaaagaaagatgtgaaatcccagggcttaaccttggaactgcatttttaactaccgggctagagtgtgtcagaggggggtggaattccgcgtgtagcagtgaaatgcgtagatatgcggaggaacaccgatggcgaaggcagccccctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcccgaagagatttgggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggttgccaaaccgcgaggtggagctaatctcagaaacccgatcgtagtccggattgtagtctgcaactcgactacatgaagtcggaatcgctagtaatcgcggatcagaatgtcgcggtgaatacgttcccgggtcttgtacacaccgcccgtcacaccatgggagtgggttctaccagaagtagttagcctaaccgcaaggaggg

SEQ ID NO: 1019 - DNA, 1541 bp, Kingella denitrificans
ttgaacataagagtttgatcctggctcagattgaacgctggcggcatgctttacacatgcaagtcggacggcagcgggggtgcttgcacctgccggcgagtggcgaacgggtgagtaacatattggaatgtaccgagtagtgggggataaccaatcgaaagattggctaataccgcatacgtcctgagggggaaagcaggggatcttcggaccttgcgctatttgagcagccaatatctgattagctagttggtggggtaaaggcccaccaaggcgacgatcagtagcgggtctgagaggatgatccgccacactgggactgagacacggcccagactcctacgggaggcagcagtggggaattttggacaatgggggcaaccctgatccagccatgccgcgtgtctgaagaaggccttcgggttgtaaaggacttttgttagggaagaaaagggaagtgttaataccactttttgttgacggtacctaaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtagctagagtatgtcagaggggggtagaattccacgtgtagcagtgaaatgcgtagagatgtggaggaataccgatggcgaaggcagccccctgggataatactgacgttcatgctcgaaagcgtgggtagcaaacaggattagataccctggtagtccacgccctaaacgatgtcgattagctgttgggcaacttgattgcttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaagaactcagagacgagtttgtgccttcgggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaaaccggaggaaggtggggatgacgtcaagtcctcatggcccttatgaccagggcttcacacgtcatacaatggtcggtacagagggtagccaagccgcgaggtggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttct

SEQ ID NO: 1020 - DNA, 1288 bp, Kingella sp.
  P1 oral cone MB2_C20
cgctggcggcatgctttacacatgcaagtcgaacgagtggcgaacgggtgagtaagatattggaacgtaccgagtaatgggggataactatccgaaaggatagctaataccgcatacggaaagacgttattcgagcggccaataactgattagctagttggaggggtaaaggcccaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgttagggaagatgacggtacctaaagaataagcaccggctaactacgtgccagcagccgcggtaatacgtagggtgcgagcgttaatcggaattactgggcgtaaagcgagcgcagacggtttattaagcaagatgtgaaatccccgagcttaacttgggaactgcgttttgaactggtaggctagagtatgtcagaggggggtagaattccacgtgtagcagtgaaatgcgtagatatcaagaagaatacctattgcgaaggcgatctgctggaactactgacgctaatgcgtgaaagcgtggggagcaaacaggattagataccctggtagtccacgccctaaacgatgtataccggttgttgctgcggcagtaatccacctaacggattaagtataccgcctggggagtacggtcgcaagattaaaactcaaaggaatagacggggacccgcacaagcggtggatgatgtggattaattcgatgcaacgcgaagaaccttacctggtcttgacatgcacaggtgctgcatggctgtcgtcagctcgtgtcgtgagatgttgggttaagtcccgcaacgagcgcaacccttgtcattagttgccaccatgggcactctaatgagactgccggtgacaaaccggaggaaggtggggatgacgtcaagtcctcatggcccttatgaccagggcttcacacgtcatacaatggtcggcagagggtagccaaaccgcgaggtggagccaatctcagccgatcgtagtccggatgcactctgcaactcgagtgcagaagtcggaatcgctagtaatcgcaggtcagcatactgcggtgaatacgttcccgggtcttgtacacaccgcccgtcacaccatgggagtgggggataccagaagtaggtggctaggccgcttaccacggtatgtttcatgactggggtg

SEQ ID NO: 1021 - DNA, 1541 bp, Kingella kingae
ttgaacataagagtttgatcctggctcagattgaacgctggcggcatgctttacacatgcaagtcggacggcagcacgagtacttgtacttggtggcgagtggcgaacgggtgagtaatatattggaacgtaccgagtaatgggggataactatccgaaaggatagctaataccgcatacgctttgagaaggaaagcaggggatcttcggaccttgcgttattcgagcggccaataactgattagctagttggtggggtaagggcccaccaaggcgacgatcagtagtgggtctgagaggatgatccgccacactgggactgagacacggcccagactcctacgggaggcagcagtggggaattttggacaatgggcgaaagcctgatccagccatgccgcgtgtctgaagaaggccttcgggttgtaaaggacttttgttagggaagaaaaggttgatgctaatatcattaactgatgacggtacctaaagaataagcaccggctaactacgtgccagcagccgcggtaatacgtagggtgcgagcgttaatcggaattactgggcgtaaagcgagcgcagacggttagttaagcaagatgtgaaatccccgagctcaacttgggaactgcgttttgaactggctagctagagtgtgtcagaggggggtagaattccacgtgtagcagtgaaatgcgtagagatgtggaggaataccgatggcgaaggcagccccctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaagagagtagagatactcttgtgccttcgggagccgtagcacaggtgctgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcctcatggcccttatgaccagggcttcacacgtcatacaatggtcggtacagagggtagccaagccgcgaggtggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtagatagggtaaccgcaaggagcccgtttaccacggtatgtttcatgactggggtgaagtcgtaacaaggtagccgtaggggaacctgcggctggatcacctcctttct

SEQ ID NO: 1022 - DNA, 1547 bp, Kingella oralis
aacataagagtttgatcctggctcagattgaacgctggcggcatgctttacacatgcaagtcgaacggcagcacgaaagagcttgctcttttggtggcgagtggcgaacgggtgagtaatgcatcggaacgtaccgagtaatgggggataactatccgaaaggatagctaataccgcatacgctttgagaaggaaagtgggggctcttcggacctcacgttattcgagcggccgatgtctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgttagggaagaaaaggatagtgttaataccattatctgctgacggtacctaaagaataagcaccggctaactacgtgccagcagccgcggtaatacgtagggtgcgagcgttaatcggaattactgggcgtaaagcgagcgcagacggtttattaagcaagatgtgaaatccccgagcttaacttgggaactgcgttttgaactggtaagctagagtatgtcagaggggggtagaattccacgtgtagcagtgaaatgcgtagagatgtggaggaataccgatggcgaaggcagccccctgggataatactgacgttcatgctcgaaagcgtgggtagcaaacaggattagataccctggtagtccacgccctaaacgatgtcaattagctgttgggcaacatgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcttccagagacggaagagtgccttcgggagccgtaacacaggtgctgcatggctgtcgtcagctcgtgtcgtgagatgttgggttaagtcccgcaacgagcgcaacccttgtcattagttgccaccattcagttgggcactctaatgagactgccggtgacaaaccggaggaaggtggggatgacgtcaagtcctcatggcccttatgaccagggcttcacacgtcatacaatggtcggtacagagggtagccaagccgcgaggtggagccaatctcagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggctaaccgcaaggaggccgcttaccacggtatgtttcatgactggggtgaagtcgtaacaaggtagccgtaggggaacctgcggctggatcacctcctttctagaga

SEQ ID NO: 1023 - DNA, 1360 bp, Kingella sp.
  oral clone ID059
gagtttgatcctggctcagattgaacgctggcggcatgctttacacatgcaagtcggacgagtggcgaacgggtgagtaatatattggaacgtaccgagtagtgggggataactaagcgaaagtttggctaataccgcatacggaaaggcgctatttgagcggccaatatctgattagctagttggtggggtaagggcttaccaaggcgatgatcagtagcgggtctgagaggatgatccgccacactgggactgagagacggcccagactcctacgggaggcagcagtggggaattttggacaatgggggcaaccctgatccagccatgccgcgtgtctgaagaaggccttcgggttgtaaaggacttttgttagggaagatgacggtacctaaagaataagcaccggctaactacgtgccagcagccgcggtaatacgtagggtgcgagcgttaatcggaattactgggcgtaaagcgagcgcagacggttatttaagtcagatgtgaaatccccgagcttaacttgggaactgcgtttgaaactgggtaactagagtatgtcagaggggggtagaattccacgtgtagcagtgaaatgcgtagagatgtggaggaataccgatggcgaaggcagccccctgggataactgacgttcatgctcgaaagcgtgggtagcaaacaggattagataccctggtagtccacgccctaaacgatgtcaattagctgttggtgcattagtagcgaagctaacgcgtgaaattgaccgcctggggagtacggtcgcaagattaaaactcaaaggaattgacggggacccgcacaagcgatggatgatgtggattaattcgatgcaacgcgaagaaccttacctggtcttgacatgcacaggtgctgcatggctgtcgtcagctcgtgtcgtgagatgttgggttaagtcccgcaacgagcgcaacccttgtcattagttgccatcatgggcactctaatgagactgccggtgacaaaccggaggaaggtggggatgacgtcaagtcctcatggcccttatgaccagggcttcacacgtcatacaatggtcggcagagggtagccaagccgcgaggtggagccaatcccaaccgatcgtagtccggatgcactctgcaactcgagtgcagaagtcggaatcgctagtaatcgcaggtcagcatactgcggtgaatacgttcccgggtcttgtacacaccgcccgtcacaccatgggagtgggggataccagaagtaggtgaatagttcgcttaccacggtatgtttcatgactggggtgaagtcgtaacaaggtagccgtaggggaacctgcggctggaacacctc

SEQ ID NO: 1024 - DNA, 1021 bp, Klebsiella oxytoca
  modified_base (741)..(742): a, c, t, g, unknown or other
  modified_base (969)..(969): a, c, t, g, unknown or other
  modified_base (974)..(975): a, c, t, g, unknown or other
  modified_base (985)..(985): a, c, t, g, unknown or other
  modified_base (1001)..(1001): a, c, t, g, unknown or other
gcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaggttaataaccttgttcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtnncgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctganacagnngctgcatggntgtcgtcagctcgtgntgtgaaatgttgggttaagt

SEQ ID NO: 1025 - DNA, 1399 bp, Klebsiella pneumoniae
tcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgttaaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttaggcggtctgtctagtcgcatgtggaactgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgc

SEQ ID NO: 1026 - DNA, 1277 bp, Klebsiella sp.
  AS10
cagattgaacgctggcggcaggcctaacacatgcaagtcgaacgagtggcggacgggtgagtaatgtctgggaaactgcctgatggagggggataactactggaaacggtagctaataccgcataaccaaagttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggatgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaactgacgctcaggtgcgaaagcgtggggagcaaacaggattagataccctggtagtccacgctgtaaacgatgtcgacttggaggttgttagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcggccgggaactcaaaggagactgccagtgataaactggaggaaggtggggatgacgtcaagtcatcatggcccttacgagtagggctacacacgtgctacaatggcatacaaagagaagcgacctcgcgagagcaagcggacctcattatgtcgtagtccggatggagtctgcaactcgactccagaagtcggaatcgctagtaatcgtggatcagaatgccacggtgaatacgttcccgggccttgtacacaccgcccgtcacaccatgggagtgggttgcaaaagaagtaggtgcttagggcgcttaccac

SEQ ID NO: 1027 - DNA, 1398 bp, Klebsiella sp.
  Co9935
tcgaacggtagcacagagagcttgctctcgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagcttgtaggtgaggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtgaggttaataaccttattcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttggtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcg

SEQ ID NO: 1028 - DNA, 1282 bp, Klebsiella sp.
  OBRC7
tggctcagattgaacgctggcggcaggcctaacacatgcaagtcgaacgagtggcggacgggtgagtaatgtctgggaaactgcctgatggagggggataactactggaaacggtagctaataccgcataaccaaagttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggatgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaactgacgctcaggtgcgaaagcgtggggagcaaacaggattagataccctggtagtccacgctgtaaacgatgtcgacttggaggttgttagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcggccgggaactcaaaggagactgccagtgataaactggaggaaggtggggatgacgtcaagtcatcatggcccttacgagtagggctacacacgtgctacaatggcatacaaagagaagcgacctcgcgagagcaagcggacctcattatgtcgtagtccggatggagtctgcaactcgactccagaagtcggaatcgctagtaatcgtggatcagaatgccacggtgaatacgttcccgggccttgtacacaccgcccgtcacaccatgggagtgggttgcaaaagaagtaggtgcttagggcgcttaccac

SEQ ID NO: 1029 - DNA, 1237 bp, Klebsiella sp.
  SP-BA
  modified_base (358)..(358): a, c, t, g, unknown or other
  modified_base (369)..(370): a, c, t, g, unknown or other
aagtcgagcgagcggcggacgggtgagtaatgtctgggaaactgcctgatggagggggataactactggaaacggtagctaataccgcataatcaaagatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggatgacgttacccgcagaagaagcaccngctaactccgnnccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaactgacgctcaggtgcgaaagcgtggggagcaaacaggattagataccctggtagtccacgccgtaaacgatgtcgatttggaggttgtgcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatcgacaggtgctgcatggctgtcgtcagctcgtgttgtgaaatgttgggttaagtcccgcaacgagcgcaacccttatcctttgttgccagcggccgggaactcaaaggagactgccagtgataaactggaggaaggtggggatgacgtcaagtcatcatggcccttacgaccagggctacacacgtgctacaatggcatacaaagagaagcgacctcgcgagagcaagcggacctcattatgtcgtagtccggatggagtctgcaactcgactccagaagtcggaatcgctagtaatcgtagatcagaatgctacggtgaatacgttcccgggccttgtacacaccgcccgtcacaccatgggagtgggttgcaaaagaagtaggtgcttagggcgct

SEQ ID NO: 1030 - DNA, 1509 bp, Klebsiella sp.
  SRC_DSD11
ccgcagagtttgatcctggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagccggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgtcaaggttaataaccttggcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtag

SEQ ID NO: 1031 - DNA, 1006 bp, Klebsiella sp.
  SRC_DSD12
  modified_base (952)..(952): a, c, t, g, unknown or other
  modified_base (957)..(957): a, c, t, g, unknown or other
  modified_base (962)..(962): a, c, t, g, unknown or other
  modified_base (971)..(973): a, c, t, g, unknown or other
  modified_base (984)..(985): a, c, t, g, unknown or other
  modified_base (995)..(995): a, c, t, g, unknown or other
tcgagcggtagcacagagagcttgctctcgggtgacgagcggcggacgggtgagtaatgtctgggaaactgcctgatggagggggataactactggaaacggtagctaataccgcataatgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccaganatggnttggngccttcggnnntgtgagacagnngctgcatggntgtcgtcagct

SEQ ID NO: 1032 - DNA, 1504 bp, Klebsiella sp.
  SRC_DSD15
agagtttgatcctggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagccggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgtcaaggttaataaccttggcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgta

SEQ ID NO: 1033 - DNA, 1506 bp, Klebsiella sp.
  SRC_DSD1
agagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataatgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctgggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtag

SEQ ID NO: 1034 - DNA, 1506 bp, Klebsiella sp.
  SRC_DSD2
agagtttgatcctggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagccggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgtcaaggttaataaccttggcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtagc

SEQ ID NO: 1035 - DNA, 1497 bp, Klebsiella sp.
  SRC_DSD6
agagtttgatcctggctcagattgaacgctggcggcaggcctaacacatgcaagtcgagcggtagcacagagagcttgctctcgggtgacgagcggcggacgggtgagtaatgtctgggaaactgcctgatggagggggataactacggaaacggtagctaataccgcataatgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgttaaggttaataaccttggcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagagggggtagaattccaggtgtagcggtgaaatgcgtagagatctgggggaataccggtggcgaagcggccccctggacaaagactgacgctcagtgcgaaagcgtggggagcaaacaggattagataccctggtagtcccgccgtaaacatgtcgatttggaggttgtgcccttgaggcgtggcttccggagctaacgcgttaaatcgacccctggggagtacggccgcaaggttaaaactcaaatgaattgacgggggcccgcacaagcggtggagcatgtggttaattcgatgcaacgcgaagaaccttacctggtcttgacatccacagaactttccagagatggattggtgcctcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaattgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaaatcgtaacaaggtagccgtagc

SEQ ID NO: 1036 - DNA, 1420 bp, Klebsiella sp.
  enrichment culture clone SRC_DSD25
tcgggtgacgagcggcggacgggtgagtaatgtctgggaaactgcctgatggagggggataactactggaaacggtagctaataccgcataatgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgttaaggttaataaccttggcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctgggggaataccggtggcgaaagcggccccctggacaaagactgacgctcagtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaattgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaaatcgtaacaaggtagccg

SEQ ID NO: 1037 - DNA, 934 bp, Klebsiella variicola
  modified_base (705)..(706): a, c, t, g, unknown or other
cggtagcacagagagcttgctctcgggtgacgagcggcggacgggtgagtaatgtctgggaaactgcctgatggagggggataactactggaaacggtagctaataccgcataatgtcgcaagaccaaagtgggggaccttcgggcctcatgccatcagatgtgcccagatgggattagctggtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtnngagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacag

SEQ ID NO: 1038 - DNA, 1387 bp, Kluyvera ascorbata
  modified_base (964)..(965): a, c, t, g, unknown or other
gcacagagagcttgctcttgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttaacgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctatttgaaggttgttcccttgaggagtggctttcggagctaacgcgttaaatagaccgcctggggagtacggccgcaaggttaaaactcaaatgaattgacgggggcccgcacaagcggtggagcatgtggtttaattcgatgcaacgcgaagaaccttacctactcttgacatccagagaaattgggagagatgctttcgcgccttcggggtnnatgagacagtggctgcatgggtgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggc

SEQ ID NO: 1039 - DNA, 1395 bp, Kluyvera cryocrescens
tcgaacggtagcacagagagcttgctcttgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttggtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagacatgctttggtgccttcgggaactctgagacagcaggcggtcggtcaagtcggatgtgaattcccaaggctcggcttaggacccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagg

SEQ ID NO: 1040 - DNA, 1482 bp, Kocuria marina
agagtttgatcatggctcaggaccaacgctggcggcgtgcttaacacatgcaagtcgaacgctgaagcttggtgcttgcactgggtggatgagtggcgaacgggtgagtaatacgtgagtaacctgcccttgactctgggataagcctgggaaactgggtctaatactggatatgacctcctgtcgcatggtggggggtggaaagggtttgtactggttgtggatgggctcacggcctatcagcttgttggtggggtaatggcctaccaaggcgacgacgggtatccggcccgagagggtgaccggccaccctgggactgagacacggcccagactcctacgggaggcagcagtggggaatattgcacaatgggcgcaagcctgatgcagcgacgccgcgtgagggatgacggccttcgggttgtaaacctctttcagcacggaagaagcgaaagtgacggtacgtgcagaagaagcgccggctaactacgtgccagcagccgcggtaatacgtaaggcgcaagcgttgtccggaattattgggcgtacagagctcgtaggcggtttgtcgcgtctgctgtgaaagcccggggcttaaccccgggtgtgcagtgggtacgggcagacttgagtgcagtaggggagactggaactcctggtgtagcggtgaaatgcgcacatatcaggaagaacaccgatggcgaaggcaggtctctgggctgttactgacgctgacgagctaaagcatggggagcgaactggattggataccctggtagtccatgccgtaaacattgggcactaggtgtgggggacattccacgttttccgcgccgtagctaacgcattaagtgccccgcctggggagtacggccgcaaggctaaaactcaaaggaattgacaggcgcccgtacaaggggcggggcatggggattatttggatgcaactcgaagaacttttccagggcttgacatacaccggatcggctcagagatgagtttccctccttttggggctggtgtacaggtggtgcatggttgtcgtcagctggtgtcgtgagatgtggggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccagtacaatgggttgcgataccgtgaggtggagctaatcccaaaaagctggtctcagttcggatcgtggtctgcaactcgaccacgtgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggactggcgattgggactaagtcgta

SEQ ID NO: 1041 - DNA, 1419 bp, Kocuria palustris
ggcggcgtcttacacatgcagtcgaacgctgaagcaccagcttgctggtgtggatgagtggcgaacgggtgagtaatacgtgagtaacctgcccttgactctgggataagcccgggaaactgggtctaatactggatgctacatgtcaccgcatggtggtgtgtggaaagggtttactggtcttggatgggctcacggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagccacaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtgtgcagtgggtacgggcagactagagtgcagtaggggagactggaattcctggtgtagcggtggaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatataccggatcgttccagagatggttcttcccctttggggtcggtatacaggtggtgcatggttgtcgtcagctcgtgtcgtgagatgttgggttaagtcccgcaacgagcgcaaccctcgttccatgttgccagcacgtgatggtggggactcatgggagactgccggggtcaactcggaggaaggtggggatgacgtcaaatcatcatgccccttatgtcttgggcttcacgcatgctacaatggccggtacaaagggttgcgatactgtgaggtggagctaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcacgaaagtcggtaacacccgaagccggtggcccaacccttgtggagggagccgtcgaaggtgg

SEQ ID NO: 1042 - DNA, 1454 bp, Kocuria rhizophila
ggacgaacgctggcggcgtgcttaacacatgcaagtcgaacgctgaagcttggtgcttgcactgggtggatgagtggcgaacgggtgagtaatacgtgagtaacctgcccttgactctgggataagcctgggaaactgggtctaatactggatacgacatgtcaccgcatggtggtgtgtggaaagggttttactggttttggatgggctcacggcctatcagcttgttggtggggtaatggctcaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagcacggaagaagcgaaagtgacggtacgtgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtgtgcagtgggtacgggcagacttgagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtggggaacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaccgggccagagatggtctttcccccttgtggggctggtgtacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtgaggatgacgtcaaatcatcatgccccttatgtcttgggcttcacgcatgctacaatggccagtacaatgggttgcgatgccgcgaggtggagctaatcccaaaaagctggtctcagttcggatcgtggtctgcaactcgaccacgtgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggactggcgattgggact

SEQ ID NO: 1043 - DNA, 1481 bp, Kocuria rosea
atcctggctcaggacgaacgctggcggcgtgcttaacacatgcaagtcgaacgatgatgcccagcttgctgggcggattagtggcgaacgggtgagtaatacgtgagtaacctgcccttgactctgggataagcctgggaaactgggtctaatactggatactacctcttaccgcatggtgggtggtggaaagggttttactggttttggatgggctcacggcctatcagcttgttggtggggtaatggctcaccaagccgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagtagggaagaagcgagagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtctgcagtgggtacgggcagactagagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacattcaccggaccgccccagagatggggtttcccttcggggctggtggacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacaaagggttgcgatactgtgaggtggagctaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagccgtcgaaggtgggactggcgattgggactaagtcgtaacaaggtagccgt

SEQ ID NO: 1044 - DNA, 1333 bp, Kocuria varians
  modified_base (1040)..(1040): a, c, t, g, unknown or other
cgctgaagcttggtgcttgcactgggtggatgagtggcgaacgggtgagtaatacgtgagtaacctgcccttaactctgggataagcctgggaaactgggtctaatactggatatgacatgtcactgcatggtggcgtgtggaaagggttttactggttttggatgggctcacggcctatcagcttgttggtggggtaatggcccaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcacggaagaagcgagagtgacggtacgtgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtgtgcagtgggtacgggcagacttgagtgcagtaggggagactggaattcctggtgtagcggtgaaatgcgcagatatcaggaagaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaccggtccagagatggatcttcccccttgtggggctggtgtacaggtggtgcatggttgtcgtcagctcgtgtcgtaagatgttgggttaagtcccgcaacgagcgcaaccctcgttntatgttgccagcacgtgatggtggggactcataggagactgccggggtcaactcggaggaaggtggggatgacgtcaaatcatcatgccccttatgtcttgggcttcacgcatgctacaatggccggtacaatgggttgcgataccgtgaggtggagctaatcccaaaaagccggtctcagttcggatcgtggtctgcaactcgaccacgtgaagtcggagtcgctagtaatcgcagatcagcaacgctgcggtgaatacgttcccgggccttgtacacaccgcccgtcaagt

SEQ ID NO: 1045 - DNA, 1493 bp, Lachnobacterium bovis
  modified_base (85)..(85): a, c, t, g, unknown or other
gagtttgatcatggctcaggatgaacgctggcggcgtgcttaacacatgcaagtcgaacgaagcacattatttgaattcttcggnaggaagataatgcgactgagtggcggacgggtgagtaacgcgtgggtaacctgccatgtacagggggacaacagttggaaacggctgctaataccgcataagcgcacgagattgcatgatctagtgtgaaaaactccggtggtatatgatggacccgcgtctgattagctagttggtaaggtaacggcttaccaaggcgacgatcagtagccgacctgagagggtgaccggccacattgggactgagacacggcccagactcctacgggaggcagcagtggggaatattgcacaatgggcgaaagcctgatgcagcgacgccgcgtgaacgaagaagtatttcggtatgtaaagttctatcagcagggaagaaaaaatgacggtacctgactaagaagccccggctaactacgtgccagcagccgcggtaatacgtagggggcaagcgttatccggatttactgggtgtaaagggagcgcaggcggcccggcaagtctgatgtgaaaacccaaggctcaaccatgggattgcattggaaactgtcgagctagagtatcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggtgttatgaacattcggtgccggcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccaatgacaagctatgtaatgtagcctctcttcggagcattggagacaggtggtgcatggttgtcgtcagctcgtgtcgtgagatgttgggttaagtcccgcaacgagcgcaacccttgtccttagtagccagcagtaagatgggcactctagggagactgccagggataacctggaggaaggtggggatgacgtcaaatcatcatgccccttatgacttgggctacacacgtgctacaatggcgtaaacaaagtgaagcgagatggtgacattaagcaaatcacaaaaataacgtctcagttcggactgtagtctgcaactcgactacacgaagctggaatcgctagtaatcgcagatcagaatgctgcggtgaatacgttcccgggtcttgtacacaccgcccgtcacaccatgggagttggtaatgcccgaagccggtgacctaaccgtaaggaaggagccgtcgaaggcaggatcgataactggggtgaagtcgtaacaaggtaacca

SEQ ID NO: 1046 - DNA, 1518 bp, Lachnospira multipara
tttgatcctggctcaggatgaacgctggcggcgtgcttaacacatgcaagtcgaacgaagcaacwtatcacgattccttcgggatgacgatttgttgactgagtggcggacgggtgagtaacgcgtgggtaacctgccttatacagggggatagcagctggaaacggctgataataccgcataagcgcacggcatcgcatgatgcagtgtgaaaaactccggtggtataagatggacccgcgtctgattagctagttggtgaggtaacggcccaccaaggcaacgatcagtagccgacctgagagggtgaccggccacattgggactgagacacggcccagactcctacgggaggcagcagtggggaatattgcacaatggaggaaactctgatgcagcgacgccgcgtgagcgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggagtgtaggtggcaaagcaagtcagtagtgaaaatccggggctcaacctcggaactgctattgaaactgtttagctagagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgttgggtctcataagagattcggtgccgcagctaacgcaataagtattccacctggggagtacgttcgcaagaatgaaactcaaaggaattgacggggacccgcacaagcggtggagcatgtggtttaattcgaagcaacgcgaagaaccttacctagtcttgacatcccgatgaccragtatgtaatgtactctttcttcggaacatcggtgacaggtggtgcatggttgtcgtcagctcgtgtcgtgagatgttgggttaagtcccgcaacgagcgcaacccctatttctagtagccagcagttcggctgggcactctagagagactgccagggataacctggaggaaggtggggatgacgtcaaatcatcatgccccttatgactagggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgaaaatgcccgaagtcggtgacctaacgtaagaaggagccgccgaaggcaggtttgataactggggtgaagtcgtaacaaggtagccgtatcggaaggtgcggctggatcacctcct

SEQ ID NO: 1047 - DNA, 1383 bp, Lachnospira pectinoschiza
  modified_base (11)..(12): a, c, t, g, unknown or other
  modified_base (14)..(14): a, c, t, g, unknown or other
  modified_base (22)..(23): a, c, t, g, unknown or other
  modified_base (30)..(31): a, c, t, g, unknown or other
  modified_base (37)..(40): a, c, t, g, unknown or other
cgaagcatttnncnacggattnnttcgganntgaagnnnnttatgactgagtggcggacgggtgagtaacgcgtgggtaacctgcctcacacagggggatagcagttggaaacggctgataataccgcataagcgcacagtaccgcatggtacagtgtgaaaaactccggtggtgtgagatggacccgcgtctgattagcttgttggcagggtaacggcctaccaaggcaacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggcatcacaagtcagaagtgaaagcccggggctcaaccccgggactgcttttgaaactgtggagctggagtgcaggagaggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggaccgcacaagcggtggagcatgtggtttaattcgaagcaacgcgaagaaccttaccaagtcttgacatcctcttgcccggtcagtaatgtgaccttttcttcggaacaagagtgacaggtggtgcatggttgtcgtcagctcgtgtcgtgagatgttgggttaagtcccgcaacgagcgcaacccctattcttagtagccagcatataaggtgggcactctaggaagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcggtgacctaacgaaagaag

SEQ ID NO: 1048 - DNA, 1519 bp, Lachnospiraceae bacterium 1_1_57FAA
agagtttgatcctggctcaggatgaacgctggcggcgtgcctaacacatgcaagtcgagcgaagcactttgcttagattcttcggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtcccgcaacgagcgcaacccctatctttagtagccagcggccaggccgggcactctagagagactgccggggataacccggaggaaggtggggatgacgtcaaatcatcatgccccttatgagcagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacct

SEQ ID NO: 1049 - DNA, 1384 bp, Lachnospiraceae bacterium 1_4_56FAA
  modified_base (33)..(33): a, c, t, g, unknown or other
  modified_base (229)..(229): a, c, t, g, unknown or other
tcgaacgaagcactttaccggatttcttcggantgaaagttttgtgactgagtggcggacgggtgagtaacgcgtgggtaacctgcctcatacagggggataacagttagaaatgactgctaataccgcataagaccacaggattgcatggtccggtggtaaaaactccggtggtatgagatggacccgcgtctgattagctagttggtggggtaacggcttaccaagncgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaagacggtacctgctaagaagcaccggctaaatacgtgccagcagccgcggtaatacgtatggtgcaagcgttatccggatttactgggtgtaaagggagcgtagacggagaggcaagtctgatgtgaaaacccggggctcaaccccgggactgcattggaaactgtttttctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggaggcaaagcctttcggtgccgcagcaaacgcaataagcagtccacctggggagtacgttcgcaagaatgaaactcaaaggaattgacggggacccgcacaagcggtggagcatgtggtttaattcgaagcaacgcgaagaaccttacctgcccttgacatccggctgactggcgagtaatgtcgcctttccttcgggacagccgagacaggtggtgcatggttgtcgtcagctcgtgtcgtgagatgttgggttaagtcccgcaacgagcgcaacccttatctttagtagccagcatttcggatgggcactctagagagactgccagggataacctggaggaaggtggggatgacgtcaaatcatcatgccccttatgggcagggctacacacgtgctacaatggcgtaaacaaagggaggcaagcctgcgagggtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagg

SEQ ID NO: 1050 - DNA, 1528 bp, Lachnospiraceae bacterium 2_1_46FAA
gagagtttgatcctggctcaggatgaacgctggcggcgtgcttaacacatgcaagtcgaacgaagcgctttcgattgaatcttcggaggaaagaggaagtgactgagtggcggacgggtgagtaacgcgtgggtaacctgcctcatacagggggataacagttagaaatggctgctaataccgcataagcatacagcaccgcatggtgcagtgtgaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagtgcaagtctgaagtgaaagcccggggctcaaccccgtgactgctttggaaactgtgcttctagagtgtcggagaggtaagcggaattcctagtgtagcggtgaaatgcgtagatattaggaggaacatcagtggcgaaggcggcttactggacgataactgacgttgaggctcgaaagcgtggggagcaaacaggattagataccctggtagtccacgccgtaaacgatgactactaggtgtcggggtacaaagtacttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctggtcttgacatctccctgactggacagtaatgtgtcctttctttcgggacagggaagacaggtggtgcatggttgtcgtcagctcgtgtcgtgagatgttgggttaagtcccgcaacgagcgcaacccctatcttcagtagccagcaagtaaagttgggcactctggagagactgccagggataacctggaggaaggtggggacgacgtcaaatcatcatgccccttatgaccagggctacacacgtgctacaatggcgtaaacaaagggaagcaagcatgtgagtgtgagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacctaaccgaaaggaaggagctgccgaaggtgggactgataactggggtgaagtcgtaacaaggtagccgtatcggaaggtgcggctggatcacctcctttct

SEQ ID NO: 1051 - DNA, 1361 bp, Lachnospiraceae bacterium 2_1_58FAA
cgaagcacttttgcggatttcttcggattgaagcaattgtgactgagcggcggacgggtgagtaacgcgtgggtaacctgcctcatacagggggataacagttggaaacggctgctaataccgcataagcgcacagtaccgcatggtaccgtgtgaaaaactccggtggtatgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgataagtatttcggtatgtaaagctctatcagcagggaagaaaatgacggtacctgctaagaagccgctaactacgtgccagcagccgcggtaatacgtagggggcaagcgttatccggatttactgggtgtaaagggagcgtagacggcatggcaagccagatgtgaaagcccggggctcaaccccgggactgcatttggaactgtcaggctagagtgtcggagaggaaagcggaattcctagtgtagcggtgaaatgcgtagatattaggaggaacaccagtggcgaaggcggctttctggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgatggggacccgcacaagcggtggagcatgtggtttaattcgaagcaacgcgaagaaccttacctggtcttgacatccctctgaccgctctttaatcggagctttccttcgggacagaggagacaggtggtgcatggttgtcgtcagctcgtgtcgtgagatgttgggttaagtcccgcaacgagcgcaacccctatctttagtagccagcatttaagatgggcactctagagagactgccagggataacctggaggaaggtggggatgacgtcaaatcatcatgccccttatgaccagggctacacacgtgctacaatggcgtaaacaaagggaagcgagcccgcgagggggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgac

SEQ ID NO: 1052 - DNA, 1373 bp, Lachnospiraceae bacterium 3_1_57FAA_CT1
aggaagttttcggatggaatcggcgtaacttagtggcggacgggtgagtaacgcgtgggaaacctgccctgtaccgggggataacacttagaaataggtgctaataccgcataagcgcacagcttcacatgaggcagtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggcaactacgtgccagcagccgcggtaatacgtagggggcaagcgttatccggatttactgggtgtaaagggagcgtagacggcatgacaagccagatgtgaaaacccagggctcaaccctgggactgcatttggaactgccaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatcccaatgacgtgtccgtaacggggcattctcttcggagcattggagacagggggagcatggcggtcgtcagctcgtgtcgtgagatgttgggttaagtcccgcaacgagcgcaacccttatccttagtagccagcaggtaaagctgggcactctagggagactgccggggataacccggaggaaggcggggatgacgtcaaatcatcatgccccttatgatttgggctacacacgtgctacaatggcgtaaacaaagggaagcgagacagtgatgttgagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagcctgtgacctaaccgcaagggaggagca

SEQ ID NO: 1053 - DNA, 1370 bp, Lachnospiraceae bacterium 4_1_37FAA
attcttcggaaggaagctcaagtgactgagtggcggacgggtgagtaacgcgtgggtaacctgcctcatacagggggataacagttagaaatgactgctaataccgcataagcacacgtgatcgcatgatcgagtgtgaaaaactccggtggtatgagatggacccgcgtctgattagcttgttggtggggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcagtgcaagtctgaagtgaaagcccggggctcaaccccgggactgctttggaaactgtgcagctggagtgtcggagaggcaagcggaattcctagtgtagcggtgaaatgcgtagatattaggaggaacaccagtggcgaaggcggcttgctggacgataactgacgttgaggctcgaaagcgtggggagcaaacaggattagataccctggtagtccacgccgtaaacgatgactactaggtgtcggggagcaaagctcttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctcttgacatccctctgaacgctcattaatcgggctcttccccggggctgcttgggaaacggtgcagctggagtgtcggagctcgtgtcgtgagatgttgggttaagtcccgcaacgagcgcaacccctatcttcagtagccagcattaaggatgggcactctggagagactgccagggataacctggaggaaggtggggatgacgtcaaatcatcatgccccttatgagcagggctacacacgtgctacaatggcgtaaacaaagggaagcagagtcgtgaggccgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctg

SEQ ID NO: 1054 - DNA, 1357 bp, Lachnospiraceae bacterium 5_1_57FAA
cgaagcgcctggccccgacttcttcggaatgaggagccttgcgactgagtggcggacgggtgagtaacgcgtgggcaacctgccttgcactgggggataacagccagaaatggctgctaataccgcataagaccgaagcgccgcatggggcagcggccaaagccccggcggtgcaagatgggcccgcgtctgattaggtagttggcggggtaacggcccaccaagccgacaatcagtagccgacctgagagggtgaccggccacattgggactgagacacggcccacactcctacgggaggcagcagtggggaatattgcacaatgggggaaaccctgatgcagcgacgccgcgtgaaggatgaagtatttcggtatgtaaacttctatcaccagggaagaaaatgacggtacctgactaagaagccccggctaactacgtgccacagccgcggtaatacgtagggggcaagcgttatccggatttactgggtgtaaagggagcgtaacggcgatgcaagccaatgtgaaagcccggggctcaaccccgggactgcatttggaactgcgtggctggagtgtcgagaggcaggcggaattctagtgtacggtgaaatgcgtaatattagaggaacaccagtggcgaagcggcctgctggacatgactgacgttgaggctcgaaagcgtggggagcacaggattaataccctggtagtccacgccgtaacgatgactactagtgtcgggtggaaggccattcgtgccgcagcaacgcaataagtagtccacctggggagtacgttcgcaagaatgaaactcaaggaattgacgggaccccacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattccggatgggcactctggagagactgccagggacaacctggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagccggtgacccaacccgca

SEQ ID NO: 1055 - DNA, 1537 bp, Lachnospiraceae bacterium 5_1_63FAA
ttgaacatgagagtttgatcctggctcaggatgaacgctggcggcgtgcttaacacatgcaagtcgaacgaaacaccttatttgattttcttcggaactgaagatttggtgattgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagagacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttct

SEQ ID NO: 1056 - DNA, 1370 bp, Lachnospiraceae bacterium 6_1_63FAA
cgaagcacttatcattgactcttcggaagatttgatatttgactgagcggcggacgggtgagtaacgcgtgggtaacctgcctcatacaggggaataacagttagaaatggctgctaatgccgcataagcgcacaggaccgcatggtctggtgtgaaaaactgaggtggtatgagatggacccgcgtctgattaggtagttggtggggtaacggcctaccaagccgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggtgcaaagcagttcggtgccgcagcaaacgcaataagtattccacctggggagtacgttcgcaagaatgaaactcaaaggaattgacggggacccgcacaagcggtggagcatgtggtttaattcgaagcaacgcgaagaagctttactaggtgtaaagggagcctagacggtacatcaactgtgatgtgaaaggcgacaggcaagacaggtggtgcatggttgtcgtcagctcgtgtcgtgagatgttgggttaagtcccgcaacgagcgcaacccctatccttagtagccagcagtccggctgggcactctagggagactgccggggataacccggaggaaggcggggacgacgtcaaatcatcatgccccttatgatttgggctacacacgtgctacaatggcgtaaacaaagggaagcgaagcggtgacgcttagcaaatctcaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaa

SEQ ID NO: 1057 - DNA, 1527 bp, Lachnospiraceae bacterium 8_1_57FAA
gagagtttgatcctggctcaggatgaacgctggcggcgtgcctaacacatgcaagtcgagcgaagcactttgcttagattcttcggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtcccgcaacgagcgcaacccctatctttagtagccagcggccaggccgggcactctagagagactgccggggataacccggaggaaggtggggatgacgtcaaatcatcatgccccttatgagcagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttct

SEQ ID NO: 1058 - DNA, 1387 bp, Lachnospiraceae bacterium 9_1_43BFAA
  modified_base (13)..(13): a, c, t, g, unknown or other
tcgaacgaagcancttgaatggaattcttcggaaggaagctcaagtgactgagtggcggacgggtgagtaacgcgtgggtaacctgcctcatacagggggataacagttagaaatgactgctaataccgcataagcacacgtgatcgcatgatcgagtgtgaaaaactccggtggtatgagatggacccgcgtctgattagcttgttggtggggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcagtgcaagtctgaagtgaaagcccggggctcaaccccgggactgctttggaaactgtgcagctggagtgtcggagaggcaagcggaattcctagtgtagcggtgaaatgcgtagatattaggaggaacaccagtggcgaaggcggcttgctggacgataactgacgttgaggctcgaaagcgtggggagcaaacaggattagataccctggtagtccacgccgtaaacgatgactactaggtgtcggggagcaaagctcttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctattgacatccctctgaccgctctttaatccgggggttccacccggggactggtttggaaaggggcatggtggtcgtcagctcgtgtcgtgagatgttgggttaagtcccgcaacgagcgcaacccctatcttcagtagccagcattaaggatgggcactctggagagactgccagggataacctggaggaaggtggggatgacgtcaaatcatcatgccccttatgagcagggctacacacgtgctacaatggcgtaaacaaagggaagcagagtcgtgaggccgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagg

SEQ ID NO: 1059 - DNA, 1483 bp, Lachnospiraceae bacterium A4
agagtttgatcatggctcaggatgaacgctggcggcgtgcttaacacatgcaagtcgaacggactcatattgaaacctagtgatgtatgagttagtggcggacgggtgagtaacgcgtggagaacctgccgtatactgggggataacacttagaaataggtgctaataccgcataagcgcacagcttcgcatgaagcagtgtgaaaaactccggtggtatacgatggatccgcgtctgattagcttgttggcggggtaaaggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtacgtaaagctctatcagcagggaagaaaatgacggtacctgactaagaagccccggctaactacgtgccagcagccgcggtaatacgtagggggcaagcgttatccggatttactgggtgtaaagggagcgtagacggcagcgcaagtctggagtgaaatcccatggcttaaccatggaactgctttggaaactgtgcagctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgctgtaaacgatgattactaggtgttgggggaccaaggtccttcggtgccgtcgcaaacgcattaagtaatccacctggggagtacgttcgcaagaatgaaactcaaaggaattgacggggacccgcacaagcggtggagcatgtggtttaattcgaagcaacgcgaagaaccttacctggtcttgacatcccagtgacgcatgagtaaagtcatgtttccttcgggacactggagacaggtggtgcatggttgtcgtcagctcgtgtcgtgagatgttgggttaagtcccgcaacgagcgcaacccctatttccagtagccagcatgtaaagatgggcactctggagagactgcctaggataactaggaggaaggcggggatgacgtcaaatcatcatgccccttatgatcagggctacacacgtgctacaatggcgtaaacaaagggaagcaaagcggtgacgccaagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcagtgacctaaccgaaagggaggagctgccgaaggtggagccggtaactggggtgaagtcgtaacaaggtaacc

SEQ ID NO: 1060 - DNA, 1485 bp, Lachnospiraceae bacterium DJF VP30
  modified_base (485)..(485): a, c, t, g, unknown or other
agagtttgatcatggctcaggatgaacgctggcggcgtgcttaacacatgcaagtcgaacggagtcatcctctgtcaaagcttcggcagagacttggttaacttagtggcggacgggtgagtaacgcgtgggtaacctgccatgtacagggggataacacttagaaataggtgctaaaaccgcataagcgcacggtaccgcatggtacagtgtgaaaaactccggtggtacatgatggacccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcaggaagaaatcaatgcggtacctgactaagaagcnccggctaactacgtgccagcagccgcggtaatacgtagggggcaagcgttatccggatttactgggtgtaaagggagcgtagacggcatggcaagtctgaagtgaaaggccagggctcaaccctgggactgctttggaaactgtcaggctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgtcggggagtatagacttttcggtgccgcagccaacgcaataagtattccacctggggagtacgttcgcaagaatgaaactcaaaggaattgacggggacccgcacaagcggtggagcatgtggtttaattcgaagcaacgcgaagaaccttacctggtcttgacatcccgatgaccggacagtaatgtgtccttttcttcggaacattggagacaggtggtgcatggttgtcgtcagctcgtgtcgtgagatgttgggttaagtcccgcaacgagcgcaacccctatcttcagtagccagcaagtaaagttgggcactctggagagactgccggggataacccggaggaaggcggggatgacgtcaaatcatcatgccccttatgaccagggctacacacgtgctacaatggcgtaaacagagggaagcgagagcgtgagctggagcaaatcccaaaaataacgtcccagttcggattgtagtctgcaactcgactacatgaagctggaatcgctagtaatcgcgaatcagcatgtcgcggtgaatacgttcccgggtcttgtacacaccgccgtcacaccatgggagtcggaaatgcccgaagtcggtgacctaaccgtaaggaaggagccgccgaagcaggtctgataactggggtgaagtcgtaaca

SEQ ID NO: 1061 - DNA, 1255 bp, Lachnospiraceae bacterium ICM62
acgctggcggcgtgcttaacacatgcaagtcgaacgagtggcggacgggtgagtaacgcgtggataacctgccttatacagggggataacggagagaaatttccgctaacaccgcataagaaaattaggtataagatggatccgcgtccgattagctagttggtgaggtaaaggcccaccaaggcgacgatcggtagccggcctgagagggtgaacggccacattgggactgagacacggcccaaactcctacgggaggcagcagtggggaatattggacaatgggggaaaccctgatccagcgacgccgcgtgagtgaagaagtatttcggtatgtaaagctctatcagcagggaagatgacggtacctgactaagaagccccggctaactacgtgccagcagccgcggtaatacgtagggggcaagcgttatccggatttactgggtgtaaagggagcgcagacggcaatgcaagtctgaagtgaaaggcgtgggctcaacccatgaactgctttggaaactgtatagcttgagtgtcggaggggtaagcggaattcctagtgtagcggtgaaatgcgtagatattaggaggaacaccggaggcgaaggcggcttactggacgaactgacgttgaggctcgaaggcgtggggagcaaacaggattagataccctggtagtccacgcagtaaacgatgaatacttggtgtcggggcttcggtgccgcagctaacgcattaagtattccacctggggagtacgttcgcaagaatgaaactcaaaggaattgacggggacccgcacaagcggtggagcatgtggtttaattcgaagcaacgcgaagaaccttaccaaatcttgacatatacaggtggtgcatggttgtcgtcagctcgtgtcgtgagatgttgggttaagtcccgcaacgagcgcaacccttgtcgtcagtagccagcatgggcactctgacgagacagccggagataatccggaggaaggtggggatgacgtcaaatcatcatgccccttatgatttgggctacacacgtgctacaatggcgtacaaagtgaagcaaagccgcgaggccaagcaaatcacaaaacgtctcagttcggatgtagtctgcaactcgactatagaagctggaatcgctagtaatcgcagatcagaatgctgcggtgaatacgttcccgggtcttgtacacaccgcccgtcacaccatgggagtcatcaatgcccgaagtcagtaccta

SEQ ID NO: 1062 - DNA, 1406 bp, Lachnospiraceae bacterium MSX33
ggcgtgcttaacacatgcaagtcgaacgaagctgcccaaaggaagttttcggatggaatttaggtagacttagtggcggacgggtgagtaacgcgtggataacctgccttatacagggggataacggagagaaatttccgctaacaccgcataagaccacagcaccgcatggtgcaggggtaaaatatttataggtataagatggatccgcgtccgattagctagttggtgaggtaaaggcccaccaaggcgacgatcggtagccggcctgagagggtgaacggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgcagacggcaatgcaagtctgaagtgaaaggcgtgggctcaacccatgaactgctttggaaactgtatagcttgagtgtcggaggggtaagcggaattcctagtgtagcggtgaaatgcgtagatattaggaggaacaccggaggcgaaggcggcttactggacgacaactgacgttgaggctcgaaggcgtggggagcaaacaggattagataccctggtagtccacgcagtaaacgatgaatacttggtgtcggggaggtaaactcttcggtgccgcaagctaacgcattaagtattccacctggggagtacgttcgcaagaatgaaactcaaaggaattgacggggacccgcacaagcggtggagcatgtggtttaattcgaagcaacgcgaagaaccttaccaaatcttgacatactcttgaatagctttgtaatgaagctagtccttcgggacaagggatacaggtggtgcatggttgtcgtcagctcgtgtcgtgagatgttgggttaagtcccgcaacgagcgcaacccttgtcgtcagtagccagcagtaagatgggcactctgacgagacagccggagataatccggaggaaggtggggatgacgtcaaatcatcatgccccttatgatttgggctacacacgtgctacaatggcgtaaacaaagtgaagcaaagccgcgaggtcaagcaaatcacaaaaataacgtctcagttcggattgtagtctgcaactcgactatatgaagctggaatcgctagtaatcgcagatcagaatgctgcggtgaatacgttcccgggtcttgtacacaccgcccgtcacaccatgggagtcatcaatgcccgaagtcagtgacctaaccgtaagga

SEQ ID NO: 1063 - DNA, 1536 bp, Lachnospiraceae bacterium oral taxon 107
ttttatatgagagtttgatcctggctcaggatgaacgctggcggcgtgcttaacacatgcaagtcgaacgaagctgcttaaaggaagttttcggatggaatttaggtagacttagtggcggacgggtgagtaacgcgtggataacctgccttatacagggggataacggagagaaatttccgctaacaccgcataagaccacagcaccgcatggtgcaggggtaaaatatttataggtataagatggatccgcgtccgattagctagttggtgaggtagaggctcaccaaggcgacgatcggtagccggcctgagagggtgaacggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgcagacggcaatgcaagtctgaagtgaaaggcgtgggctcaacccatgaactgctttggaaactgtatagcttgagtgtcggaggggtaagcggaattcctagtgtagcggtgaaatgcgtagatattaggaggaacaccggaggcgaaggcggcttactggacgacaactgacgttgaggctcgaaggcgtggggagcaaacaggattagataccctggtagtccacgcagtaaacgatgaatacttggtgtcggagaggtaaactcttcggtgccgcaagctaacgcattaagtattccacctggggagtacgttcgcaagaatgaaactcaaaggaattgacggggacccgcacaagcggtggagcatgtggtttaattcgaagcaacgcgaagaaccttaccaaatcttgacatactcttgaatagtcttgtaatgagactagtccttcgggacaagggatacaggtggtgcatggttgtcgtcagctcgtgtcgtgagatgttgggttaagtcccgcaacgagcgcaacccttgtcgtcagtagccagcagtaagatggggactctgacgagacagccggagataatccggaggaaggtggggatgacgtcaaatcatcatgccccttatgatttgggctacacacgtgctacaatggcgtaaacaaagtgaagcaaagctgcgaagccaagcaaatcacaaaaataacgtctcagttcggattgtagtctgcaactcgactatatgaagctggaatcgctagtaatcgcagatcagaatgctgcggtgaatacgttcccgggtcttgtacacaccgcccgtcacaccatgggagtcatcaatgcccgaagtcagtgacctaaccgtaaggaaggagctgccgaaggcagggaggataactggggtgaagtcgtaacaaggtagccgtatcggaaggtgcggctggatcacctcctttct

SEQ ID NO: 1064 - DNA, 1487 bp, Lachnospiraceae bacterium oral taxon F15
agagtttgatcctggctcaggatgaacgctggcggcgtgcttaacacatgcaagtcgaacgaagcatttagaagttttcggacggaagaatgacttagtggcggacgggtgagtaacgcgtgggtaacctgccttatacagggggataacagttggaaacgactgctaataccgcataacccgatagagtcgcatgacttagtcggaaaagatttatcggtataagatggacccgcgtctgattagctagttggtgaggtaatggcccaccaaggcgacgatcagtagccggcttgagagagtgaacggccacattgggactgagacacggcccaaactcctacgggaggcagcagtggggaatattgcacaatgggggaaaccctgatgcagcaacgccgcgtgaaggatgaagtatttcggtatgtaaacttctatcagcagggaagaaattgacggtacctgactaagaagccccggctaactacgtgccagcagccgcggtaatacgtagggggcaagcgttatccggatttactgggtgtaaagggagcgtaggcggcaatgcaagtccgatgtgaaagcccggggctcaaccccgggactgcattagaaactgtgttgctagagtgcaggagaggtaagtggaattcctagtgtagcggtgaaatgcgtagatattaggaggaacaccagtggcgaaggcgacttactggactgaaactgacgctgaggctcgaaagcgtggggagcaaacaggattagataccctggtagtccacgccgtaaacgatgaatactaggtgtcggggcccatccgggcttcggtgccgcggctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccattgaccgtcccgtaacggggacttctcttcggagcaatggagacaggtggtgcatggttgtcgtcagctcgtgtcgtgagatgttgggttaagtcccgcaacgagcgcagcccttatctttagtagccagcatttaaggtgggcactctagagagactgccggggataacccggaggaaggcggggatgacgtcaaatcatcatgccccttatgatttgggctacacacgtgctacaatggcgtaaacaaagggaagcaacagggtgacctcaagcaaatcccaaaaataacgtcccagttcggattgtagtctgcaactcgactacatgaagctggaatcgctagtaatcgcggatcagaatgccgcggtgaatacgttcccgggtcttgtacacaccgcccgtcacaccatgggagtcggaaatgcccgaagtcagtgacccaaccgcaaggagggagctgccgaaggtggagccgataactggggtgaagtcgtaacaaggtagccgt

SEQ ID NO: 1065 - DNA, 1330 bp, Lachnospiraceae sp.
  C1
gatgaacgctggcggcgtgcttaacacatgcaagtcgaacgaatggcggacgggtgagtaacgcgtgggtaacctgcctcatacagggggataacagttggaaacgactgttaataccgcataagaaaaagtggtatgagatggacccgcgttcgattagccagttggcggggtaacggcccaccaaagcgacgatcgatagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagatgacggtacctgagtaagaagccccggctaactacgtgccagcagccgcggtaatacgtagggggcaagcgttatccggatttactgggtgtaaagggagcgcagacggctctgcaagtctgaagtgaaagcccgcggcttaaccgcgggactgctttggaaactgcaaggcttgagtatcggaggggcaggcggaattcctagtgtagcggtgaaatgcgtagatattaggaagaacaccggtggcgaaggcggcctgctggacgaactgacgttgaggctcgaaggcgtggggagcaaacaggattagataccctggtagtccacgcggtaaacgatgaatactaggtgttggtgcatcggtgccgtcgcaaacgcaataagtattccacctggggagtacgttcgcaagaatgaaactcaaaggaattgacggggacccgcacaagcagtggagcatgtggtttaattcgaagcaacgcgaagaaccttaccaaatcttgacatcgacaggtggtgcatggttgtcgtcagctcgtgtcgtgagatgttgggttaagtcccgcaacgagcgcaacccctattgccggtagccagcagctgggcactccggcgagactgcccgggataaccgggaggaaggcggggatgacgtcaaatcatcatgccccttatgatttgggcaacacacgtgctacaatggcgttcaaagagaagcgagaacgcgagtttaagcaaagctcaaaacgtctcagttcggatgcagtctgcaactcgactgcagaagctggaattgctagtaatcgcgaatcagcatgtcgcggtgaatacgttcccgggtcttgtacacaccgcccgtcacaccatgggagtcagcaacgcccgaagtcggtacccagggagctgccgaaggcggggcggataactggggtgaagtcgtaacaaggtagccgtatcggaaggtgc

SEQ ID NO: 1066 - DNA, 1406 bp, Lactobacillus acidipiscis
  modified_base (69)..(69): a, c, t, g, unknown or other
  modified_base (461)..(461): a, c, t, g, unknown or other
  modified_base (651)..(651): a, c, t, g, unknown or other
  modified_base (678)..(678): a, c, t, g, unknown or other
  modified_base (828)..(828): a, c, t, g, unknown or other
  modified_base (1221)..(1221): a, c, t, g, unknown or other
  modified_base (1223)..(1223): a, c, t, g, unknown or other
  modified_base (1242)..(1242): a, c, t, g, unknown or other
  modified_base (1247)..(1247): a, c, t, g, unknown or other
  modified_base (1268)..(1268): a, c, t, g, unknown or other
  modified_base (1282)..(1282): a, c, t, g, unknown or other
  modified_base (1287)..(1287): a, c, t, g, unknown or other
  modified_base (1321)..(1321): a, c, t, g, unknown or other
  modified_base (1386)..(1386): a, c, t, g, unknown or other
acgctggcggcgtgcctaatacatgcaagtcgaacgcaatctttgaccaatgagtgcttgcactcagcngtcaaagtgcgagtggcgaacgggtgagtaacacgtgggcaatctgcccaaaagtgggggataacacttggaaacaggtgctaataccgcatcaaccggctgaccgcatggtcggccgggcaaagacggcgtcagctgtcgcttttggatgagcccgcggcgtattaactagttggtaaggtaacggcttaccaaggtgatgatacgtagccgaactgagaggttgatcggccacattgggactgagacacggcccaaactcctacgggaggcagcagtagggaatcttccacaatggacgcaagtctgatggagcaacgccgcgtgtatgaagaaggtcttcggatcgtaaaatactgttgtcagagaagaacacgtgatagagtaactgntatggcgctgacggtatctgaccagcaagtcacggctaactacgtgccagcagccgcggtaatacgtaggtggcaagcgttgtccggatttattgggcgtaaagggaacgcaggcggtcttttaagtctgatgtgaaagccttcggcttaaccggagaagtgcattggaaactggaagacttgagtgcanaagaggagagtggaactccatgtgtancggtgaaatgcgtaaatatatggaagaacaccagtggcgaaagcggctctctggtctgtaactgacgctgaggttcgaaagcgtggggagcgaacaggattagataccctggtagtccacgctgtaaacgatgaatgctaggtgttgganggtttccgcccttcggtgccgcagctaacgcactaagcattccgcctggggagtacgatcgcaagattgaaactcaaaggaattgacgggggcccgcacaagcggtggagcatgtggtttaattcgaagcaacgcgaagaaccttaccaggtcttgacatcttttgaccatctgagagatcagaatttcccttcggggacaaaatgacaggtggtgcatggctgtcgtccagctcgtgttcgtgagatgttgggttaagtcccgcaacgagcgcaacccttattgtcagttgccagcattcagttgggcactctggcgagactgccggtgacaaaccggaggaaggtggggatgacgtcaagtcatcatgccccttatgacctgggctacacncntgctacaatggacgatacnacgantcgcgagaccgcgaggtttanctaatctctgaaantcgtnctcagttcggatcgtaggctgcaactcgcctacntgaagtcggaatcgctagtaatcgcggatcagcatgccgcggtgaatacgttcccgggccttgtncacaccgcccgtcacaccat

SEQ ID NO: 1067 - DNA, 1421 bp, Lactobacillus acidophilus
agcgagctgaaccaacagattcacttcggtgatgacgttgggaacgcgagcggcggatgggtgagtaacacgtggggaacctgccccatagtctgggataccacttggaaacaggtgctaataccggataagaaagcagatcgcatgatcagcttataaaaggcggcgtaagctgtcgctatgggatggccccgcggtgcattagctagttggtagggtaacggcctaccaaggcaatgatgcatagccgagttgagagactgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctaatgcaatccgtagagatacgtatttcccttcggggacactaagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacacacgtgctacaatggacagtacaacgaggagcaagcctgcgaaggcaagcgaatctcttaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccttcgggaaggagcc

SEQ ID NO: 1068 - DNA, 1515 bp, Lactobacillus alimentarius
  modified_base (1)..(1): a, c, t, g, unknown or other
  modified_base (82)..(82): a, c, t, g, unknown or other
  modified_base (214)..(214): a, c, t, g, unknown or other
  modified_base (217)..(217): a, c, t, g, unknown or other
  modified_base (260)..(260): a, c, t, g, unknown or other
  modified_base (359)..(360): a, c, t, g, unknown or other
  modified_base (765)..(765): a, c, t, g, unknown or other
  modified_base (767)..(767): a, c, t, g, unknown or other
  modified_base (957)..(957): a, c, t, g, unknown or other
  modified_base (992)..(992): a, c, t, g, unknown or other
ntaatatgagagtttgatcctggctcaggacgaacgctggcggcatgcctaatacatgcaagtcgaacgaactttcctattnattgatgcttgcatcatgatttagatctaagtgagtggcggacgggtgagtaacacgtgggtaacctgcccagaagtgggggataacatttggaaacaagtgctaataccgcataacaacattaaacacatnttntttgtttaaaagatggttttgctatctcttctggatggacccncggcgtattagctagttggtgaggtaatagctcaccaaggcgatgatacgtagccgacctgagagggtaatcggccacattgggactgagacacggccnnaactcctacgggaggcagcagtagggaatcttccacaatggacgaaagtctgatggagcaatgccgcgtgagtgaagaaggttttcggatcgtaaaactctgttgttgaagaagaacatatgtgagagtaactgttcacgtactgacggtattcaaccagaaagccacggctaactacgtgccagcagccgcggtaatacgtaggtggcaagcgttgtccggatttattgggcgtaaagagaatgtaggcggttcattaagtttgaagtgaaagccctcggctcaaccgaggaagtgcttcgaaaactggtgaacttgagtgcagaagaggaaagtggaactccatgtgtagcggtggaatgcgtagatatatggaagaacaccagtggcgaaggcggctttctngnctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggccngcacaagcggtggagcatgtggtttaattcgaagnaacgcgaagaaccttaccaggtcttgacataccatgaaaagctaagagattagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgataaaccggaggaaggtggggacgacgtcaaatcatcatgccccttatgacctgggctacacacgtgctacaatggtcggtacaacgtgttgcgaactcgcgagggcaagcaaatcacttaaaaccgatctcagttcggattgcaggctgcaactcgcctgcatgaagctggaatcgctagtaatcgcggatcagcatgccgcggtgaatacgttcccgggccttgtacacaccgcccgtcacaccatgagagtttgtaacacccaaagtcggtggggtaacccttcggggaactagccgcctaaggtgggacaaatgattaggg

SEQ ID NO: 1069 - DNA, 1561 bp, Lactobacillus amylolyticus
tgagagtttgatcctggctcaggacgaacgctggcggcgtgcctaatacatgcaagtcgagcgagcagaactaacagatctacttcggtagtgacgtttcggaagcgagcggcggatgggtgagtaacacgtgggtaacctgcccttaagtctgggataccacttggaaacaggtgctaataccggataacaacaagtgctgcatggcacttgcttgaaaggcggcgcaagctgtcgctaaaggatggacccgcggtgcattagctagttggtaaggtaacggcttaccaaggcaacgatgcatagccgagttgagagactgatcggccacattgggactgagacacggcccaaactcctacgggaggcagcagtagggaatcttccacaatgggcgaaagcctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggagaaataagtctgatgtgaaagccctcggcttaaccggggaattgcatcggaaactgtttttcttgagtgcagaagaggagagtggaactccatgtgtagcggtggaatgcgtagatatatggaggaacaccagtggcgaaggcggctctctggtctgtaactgacgctgaggctcgaaagcatgggtagcgaacaggattagataccctggtagtccatgccgtaaacgatgagtgctaagtgttgggaggcttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgcaatccgtagagatacggagttcccttcggggacgctaagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggacgacgtcaagtcatcatgccccttatgacctgggctacacacgtgctacaatgggcagtacaacgagaagcaagcctgcgaaggcaagcgaatctctgaaagctgttctcagttcggactgcagtctgcaactcgactgcacgaagctggaatcgctagtaatcgcggatcagcacgccgcggtgaatacgttcccgggtcttgtacacaccgcccgtcacaccatgggagtctgcaatgcccgaagccggtggcctaaccttcgggaaggagccgtctaaggcagggcagatgactggggtgaagtcgtaacaaggtagccgtaggagaacctgcggctggatcacctcctttct

SEQ ID NO: 1070 - DNA, 1575 bp, Lactobacillus amylovorus
tttaaaatgagagtttgatcctggctcaggacgaacgctggcggcgtgcctaatacatgcaagtcgagcgagcggaaccaacagatttacttcggtaatgacgttgggaaagcgagcggcggatgggtgagtaacacgtggggaacctgcccctaagtctgggataccatttggaaacaggtgctaataccggataataaagcagatcgcatgatcagcttttgaaaggcggcgtaagctgtcgctaagggatggccccgcggtgcattagctagttggtaaggtaacggcttaccaaggcgacgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaaaaataagtctaatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgcaatctgtagagatacggagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagtacaacgagaagcaagcctgcgaaggcaagcgaatctctgaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccttcgggaaggagccgtctaaggcagggcagatgactggggtgaagtcgtaacaaggtagccgtaggagaacctgcggctggatcacctcctttctaaggaag

SEQ ID NO: 1071 - DNA, 938 bp, Lactobacillus antri
  modified_base (16)..(16): a, c, t, g, unknown or other
  modified_base (18)..(18): a, c, t, g, unknown or other
  modified_base (20)..(21): a, c, t, g, unknown or other
  modified_base (603)..(603): a, c, t, g, unknown or other
  modified_base (642)..(642): a, c, t, g, unknown or other
  modified_base (661)..(661): a, c, t, g, unknown or other
  modified_base (699)..(699): a, c, t, g, unknown or other
  modified_base (768)..(768): a, c, t, g, unknown or other
  modified_base (777)..(777): a, c, t, g, unknown or other
  modified_base (798)..(798): a, c, t, g, unknown or other
  modified_base (836)..(836): a, c, t, g, unknown or other
  modified_base (844)..(844): a, c, t, g, unknown or other
  modified_base (855)..(855): a, c, t, g, unknown or other
  modified_base (913)..(913): a, c, t, g, unknown or other
  modified_base (916)..(916): a, c, t, g, unknown or other
  modified_base (918)..(919): a, c, t, g, unknown or other
  modified_base (931)..(931): a, c, t, g, unknown or other
tgcactgaattgacgntngnntcccagtgagcggcggacgggtgagtaacacgtgggcaacctgccctgaagcgggggataacatctggaaacaggtgctaataccgcataacaacgaaaaccacatggttttcgtttcaaagatggtttcggctatcacttcaggatgggcccgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaanaggacagtggaactccatgtgtagcggtggaatgcgtanatatatggaagaacaccantggcgaaggcggctgtctggtctgcaactgacgctgangctcgaaagcatgggtagcgaacaggattagataccctggtagtccatgccgtaaacgatgagtgctangtgttgganggtttccgcccttcagtgccngagctaacgcattaagcactccgcctggggagtacgancgcaaggntgaaactcaanggaattgacgggggcccgcacaagcggtggagcatgtggtttaattcgaagctacgcnaanannttaccaggtctngacatct

SEQ ID NO: 1072 - DNA, 1430 bp, Lactobacillus brevis
gaacgagcttccgttgaatgacgtgcttgcactgatttcaacaatgaagcgagtggcgaactggtgagtaacacgtgggaaatctgcccagaagcaggggataacacttggaaacaggtgctaataccgtataacaacaaaatccgcatggattttgtttgaaaggtggcttcggctatcacttctggatgatcccgcggcgtattagttagttggtgaggtaaaggcccaccaagacgatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacctttgagagtaactgttcaagggttgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttctgccaatcttagagataagacgttcccttcggggacagaatgacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggatgacgtcaaatcatcatgccccttatgacctgggctacacacgtgctacaatggacggtacaacgagtcgcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaa

SEQ ID NO: 1073 - DNA, 1578 bp, Lactobacillus buchneri
tttaagatgagagtttgatcctggctcaggacgaacgctggcggcgtgcctaatacatgcaagtcgaacgcgtcttggtcaatgaagttgagtgcttgcatttaactgatttgacattaagacgagtggcgaactggtgagtaacacgtgggtaacttgccccgaagcgggggataacatttggaaacaggtgctaataccgcataacaacaaaaaccacatggtttttgtttaaaagatggtttcggctatcactttgggatggacccgcggcgtattagctagttggtgaggtaatggctcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacgggtgtcagagtaactgttgacatcgtgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgctaacctaagagattaggcgttcccttcggggacggaatgacaggtggtgcatggttgtcgtcagctcgtgtcgtgagatgttgggttaagtcccgcaacgagcgcaacccttattgtcagttgccagcatttagttgggcactctggcgagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccgggccttgtacacaccgcccgtcacaccatgagagtttgtaacacccaaagccggtgaggtaaccttcgggggccagccgtctaaggtgggacagatgattagggtgaagtcgtaacaaggtagccgtaggagaacctgcggctggatcacctcctttct

SEQ ID NO: 1074 - DNA, 1573 bp, Lactobacillus casei
tttatatgagagtttgatcctggctcaggatgaacgctggcggcgtgcctaatacatgcaagtcgaacgagttctcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaacggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttct

SEQ ID NO: 1075 - DNA, 1544 bp, Lactobacillus catenaformis
  modified_base (67)..(67): a, c, t, g, unknown or other
  modified_base (319)..(319): a, c, t, g, unknown or other
  modified_base (327)..(328): a, c, t, g, unknown or other
  modified_base (373)..(373): a, c, t, g, unknown or other
  modified_base (581)..(581): a, c, t, g, unknown or other
  modified_base (602)..(605): a, c, t, g, unknown or other
  modified_base (639)..(639): a, c, t, g, unknown or other
  modified_base (753)..(756): a, c, t, g, unknown or other
  modified_base (920)..(921): a, c, t, g, unknown or other
  modified_base (1432)..(1432): a, c, t, g, unknown or other
  modified_base (1473)..(1473): a, c, t, g, unknown or other
  modified_base (1479)..(1479): a, c, t, g, unknown or other
  modified_base (1488)..(1496): a, c, t, g, unknown or other
  modified_base (1505)..(1529): a, c, t, g, unknown or other
tggagagtttgatcctggctcaggatgaacgctggcggcgtgcctaatacatgcaagtcgaacgggntgccattaggcactagtggcgaacgggtgaggagcacatggggaacctgcccgtcagagggggacaacagctggaaacggctgctaagaccgcataggctcaaggagggcatcctcgttgagttaaagtgtcctttcggggacagctgacggatggacctgtggcgcattagctagttggcggggtaaaggcccaccaaggcgacgatgcgtagccggcctgagagggcggacggccacactgggactgagncacggccnngactcctgcgggaggcagcagtagggaattttcggcaatgggggnaaccctgaccgagcaacgccgcgtgagtgaggaaggccttcgggctgtaaagctctgttgcagaggaagaacgggagagcgaggaaatgcgcttttcgtgacggtactctgcgagaaagccacggctaactacgtgccagcagccgcggtaatacgtaggtggcgagcgttatccggaatcattgggcgtaaagagggagcaggcggnacgcgaaggtccgtagtaaannnngaagctaaacttcgggcggctatggaaaccgcgncgcctggagtgcggaagaggaactcggaattccatgtgtagcggtgaaatgcgtagatatatggaggaacaccggtggcgaaggcggcggtctggtccggcactgacgctcagnnnngaaagcgtggggagcaaataggattagataccctagtagtccacgctgtaaacgatcgataccaggtgtcgggagtcacatcccggtgccgaagccaacgcattaagtatcgcgcctgagtagtacgtccgcaaggatgaaactcaaaggaattgacgggggcnngcacaagcggtggagcatgtggtttaattcgaagcaacgcgaagaaccttaccaggccttgacatcgatccgatcgcgcggagacgcgcgagaccttgccgaaagggaaggaggagaagacaggtggtgcatggttgtcgtcagctcgtgtcgtgagatgttgggttaagtcccgcaacgagcgcaacccctgccgccagttgccagcattcaggatggggactctggcgggactgcccctgtaagggggaggaaggcggggatgacgtcaaatcatcatgccccttatggcctgggctacacacgtgctacaatggacggagcagagggaggcgaagccgcgaggcggagcggagcccagaaacccgttcacagttcggactgcagcctgcaactcggctgcacgaagctggaatcgctagtaatcgcagatcagcatgctgcggtgaatacgttcccgggccttgtacacaccgcccgtcacaccatgagagtcggcaacgcccgaagncggcggcccaaccccgtaaggggagggagcagtcaaaggcngggcanatgattggnnnnnnnnngtaacaagnnnnnnnnnnnnnnnnnnnnnnnnngatcacctcctttct

SEQ ID NO: 1076 - DNA, 1573 bp, Lactobacillus coleohominis
tgagagtttgatcctggctcaggatgaacgccggcggtgtgcctaatacatgcaagtcgaacgcgttggcccgactgattgatgatgcttgcatcagattgacgacggtttaccaacgagtggcggacgggtgagtaacacgtaggcaacctgcccagaagcgggggacaacatttggaaacaagtgctaataccgcataacaacgaaaactgcctggttttcgtttaaaagatggtttcggctatcacttctggatgggcctgcggcgcattagctagttggtaaggcaacggcttaccaaggcagtgatgcgtagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaaactctgttgttgaagaagaacgtgcgtgagagtaactgttcacgcagtgacggtattcaaccagaaagtcacggctaactacgtgccagcagccgcggtaatacgtaggtggcaagcgttatccggatttattgggcgtaaagcgagcgcaggcggttttctaagtctgatgtgaaagccttcggcttaaccggagaagggcatcggaaactggataacttgagtgcaagagaggacagtggaactccatgtgtagcggtggaatgcgtagatatatggaagaacaccagtggcgaaggcggctgtctagcttgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaacctcagagatgaggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagcagcgaactcgcaagggccagctaatctcttaaaaccgttctcagttcggactgcagtctgcaactcgactgcacgaagtcggaatcgctagtaatcgcggatcagcatgccgcggtgaatacgttcccgggccttgtacacaccgcccgtcacaccatgggagtttgcaatgcccaaagccggtggcctaaccttcgggaaggagccgtctaaggcagggcagatgactggggtgaagtcgtaacaaggtagccgtaggagaacctgcggctggatcacctcctttcta

SEQ ID NO: 1077 - DNA, 1518 bp, Lactobacillus coryniformis
  modified_base (1)..(2): a, c, t, g, unknown or other
  modified_base (116)..(116): a, c, t, g, unknown or other
  modified_base (150)..(151): a, c, t, g, unknown or other
  modified_base (220)..(220): a, c, t, g, unknown or other
  modified_base (247)..(247): a, c, t, g, unknown or other
  modified_base (263)..(263): a, c, t, g, unknown or other
  modified_base (362)..(363): a, c, t, g, unknown or other
  modified_base (464)..(464): a, c, t, g, unknown or other
  modified_base (573)..(573): a, c, t, g, unknown or other
  modified_base (639)..(639): a, c, t, g, unknown or other
  modified_base (763)..(763): a, c, t, g, unknown or other
  modified_base (790)..(790): a, c, t, g, unknown or other
  modified_base (792)..(793): a, c, t, g, unknown or other
  modified_base (960)..(960): a, c, t, g, unknown or other
  modified_base (995)..(995): a, c, t, g, unknown or other
  modified_base (1080)..(1080): a, c, t, g, unknown or other
  modified_base (1181)..(1181): a, c, t, g, unknown or other
  modified_base (1391)..(1391): a, c, t, g, unknown or other
  modified_base (1416)..(1416): a, c, t, g, unknown or other
  modified_base (1430)..(1430): a, c, t, g, unknown or other
  modified_base (1436)..(1436): a, c, t, g, unknown or other
  modified_base (1497)..(1497): a, c, t, g, unknown or other
  modified_base (1511)..(1511): a, c, t, g, unknown or other
  modified_base (1514)..(1515): a, c, t, g, unknown or other
nnttatatgagagtttgatcctggctcaggacgaacgctggcggcgtgcctaatacatgcaagtcgaacgcactgacgtcgaccgaagctgcttgcagtggacgttgattgacgtnagtggcggacgggtgagtaacacgtgggtaaccnncccttaagtgggggataacatttggaaacagatgctaataccgcataaccattcagaccacatggtctnaatgtaaaagacggcctttggctgtcncttttggacggacccncggcgtattagttagttggtaaggtaacggcttaccaagacaatgatacgtagccgacctgagagggtaatcggccacattgggactgagacacggccnnaactcctacgggaggcagcagtagggaatcttccacaatggacgaaagtctgatggagcaacgccgcgtgagtgaagaaggttttaggatcgtaaaactcngttgttggagaagaacagggactagagtaactgttagtcctttgacggtatccaaccagaaagccacggctaactacgtgccagcagccgcggtaatacgtaggtggcnagcgttgtccggatttattgggcgtaaagcgagcgcaggcggttttttaagtctgatgtgaaagcnttcggcttaaccgaagaagtgcattagaaactggraaacttgagtgcagaagaggacagtggaactccatgtgtagcggtgaaatgcgtagatatatggaagaacaccagtggcgaaggcggcngtctggtctgtaactgacgctgaggcncnnaagtatggggagcgaacaggattagataccctggtagtccataccgtaaacgatgaatgctaagtgttggagggtttccgcccttcagtgctgcagctaacgcattaagcattccgcctggggagtacgaccgcaaggttgaaactcaaaggaattgacgggggccngcacaagcggtggagcatgtggtttaattcgaagnaacgcgaagaaccttaccaggtcttgacatcctttgaccactgtagagatacagctttcccttcggggacaaagtgacaggtggngcatggttgtcgtcagctcgtgtcgtgagatgttgggttaagtcccgcaacgagcgcaacccttatgactagttgccagcatttagttgggcactctagtnagactgccggtgacaaaccggaggaaggtggggatgacgtcaaatcagcatgccccttatgacctgggctacacacgtgctacaatggtcggtacaacgagttgcgaacccgcgagggtaagctaatctcttaaagccgatctcagttcggattgtaggctgcaactcgcctacatgaagccggaatcgctagtaatcgcggatcagcangccgcggtgaatacgttcccgggcnttgtacacaccgcncgtcanaccatgagagtttgtaacacccgaagtcggtggggtaacccttttagggaactagccgccnaaggtgggacagangannggg

SEQ ID NO: 1078 - DNA, 1562 bp, Lactobacillus crispatus
tgagagtttgatcctggctcaggacgaacgctggcggcgtgcctaatacatgcaagtcgagcgagcggaactaacagatttacttcggtaatgacgttaggaaagcgagcggcggatgggtgagtaacacgtggggaacctgccccatagtctgggataccacttggaaacaggtgctaataccggataagaaagcagatcgcatgatcagcttttaaaaggcggcgtaagctgtcgctatgggatggccccgcggtgcattagctagttggtaaggtaaaggcttaccaaggcgatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagtgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccatttgtagagatacaaagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagtacaacgagaagcgagcctgcgaaggcaagcgaatctctgaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccttcgggaaggagccgtctaaggcagggcagatgactggggtgaagtcgtaacaaggtagccgtaggagaacctgcggctggatcacctcctttcta

SEQ ID NO: 1079 - DNA, 1559 bp, Lactobacillus curvatus
aagtttgattatagctcaggacgaacgctggcggcgtgcctaatacatgcaagtcgaacgcactctcgttagattgaagaagcttgcttctgattgataacatttgagtgagtggcggacgggtgagtaacacgtgggtaacctgccctaaagtgggggataacatttcggaaacagatgctaataccgcataaaacctaacaccgcatggtgcaaggttgaaagatggtttcggctatcactttaggatggacccgcggtgcattagttagttggtgaggtaaaggctcaccaagaccgtgatgcatagccgacctgagagggtaatcggccacactgggactgagacacggcccagactcctacgggaggcagcagtagggaatcttccacaatggacgaaagtctgatggagcaacgccgcgtgagtgaagaaggttttcggatcgtaaaactctgttgttggagaagaacgtatttgatagtaactgatcaggtagtgacggtatccaaccagaaagccacggctaactacgtgccagcagccgcggtaatacgtaggtggcaagcgttgtccggatttattgggcgtaaagcgagcgcaggcggtttcttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggatgtctggtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggatggtacaacgagtcgcgagaccgcgaggtttagctaatctcttaaaaccattctcagttcggattgtaggctgcaactcgcctacatgaagccggaatcgctagtaatcgcggatcagcatgccgcggtgaatacgttcccgggccttgtacacaccgcccgtcacaccatgagagtttgtaacacccaaagccggtgaggtaaccttcgggagccagccgtctaaggtgggacagatgattagggtgaagtcgtaacaaggtagccgtagagaacctgcggctggatcacctct

SEQ ID NO: 1080 - DNA, 1568 bp, Lactobacillus delbrueckii
ttcaaattgagagtttgatcctggctcaggacgaacgctggcggcgtgcctaatacatgcaagtcgagcgagctgaattcaaagatcccttcggggtgatttgttggacgctagcggcggatgggtgagtaacacgtgggcaatctgccctaaagactgggataccacttggaaacaggtgctaataccggataacaacatgaatcgcatgattcaagtttgaaaggcggcgcaagctgtcactttaggatgagcccgcggcgcattagctagttggtggggtaaaggcctaccaaggcaatgatgcgtagccgagttgagagactgatcggccacattgggactgagacacggcccaaactcctacgggaggcagcagtagggaatcttccacaatggacgcaagtctgatggagcaacgccgcgtgagtgaagaaggtcttcggatcgtaaagctctgttgttggtgaagaaggatagaggcagtaactggtctttatttgacggtaatcaaccagaaagtcacggctaactacgtgccagcagccgcggtaatacgtaggtggcaagcgttgtccggatttattgggcgtaaagcgagcgcaggcggaatgataagtctgatgtgaaagcccacggcttaaccgtggaactgcatcggaaactgtcattcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagcgctaggtgttggggactttccggttctcagtgccgcagcaaacgcgttaagcgctccgcctggggagtacgaccgcaaggttgaaactcaaaggaattgacgggggcccgcacaagcggtggagcatgtggtttaattcgaagcaacgcgaagaaccttaccaggtcttgacatcctgcgctacacctagagataggtggttcccttcggggacgcagagacaggtggtgcatggctgtcgtcagctcgtgtcgtgagatgttgggttaagtcccgcaacgagcgcaacccttgtctttagttgccatcattaagttgggcactctaaagagactgccggtgacaaaccggaggaaggtggggatgacgtcaagtcatcatgccccttatgacctgggctacacacgtgctacaatgggcagtacaacgagaagcgaacccgcgagggtaagcggatctcttaaagctgctctcagttcggactgcaggctgcaactcgcctgcacgaagctggaatcgctagtaatcgcggatcagcacgccgcggtgaatacgttcccgggccttgtacacaccgcccgtcacaccatggaagtctgcaatgcccaaagtcggtgagataacctttataggagtcagccgcctaaggcagggcagatgactggggtgaagtcgtaacaaggtagccgtaggagaacctgcggctggatcacctcctttct

SEQ ID NO: 1081 - DNA, 1464 bp, Lactobacillus dextrinicus
  modified_base (394)..(394): a, c, t, g, unknown or other
  modified_base (397)..(397): a, c, t, g, unknown or other
  modified_base (781)..(781): a, c, t, g, unknown or other
ctggcggcgtgcctaatacatgcaagtcgaacgagtttgcttttaatgaaggcggtgcttgcaccaactgatttaaaaataaacgagtggcggacgggtgagtaacacgtgggtaacctaccctaaagtgggggataacatttggaaacagatgctaataccgcataatatcaaaaaccacatggtttttaattgaaagacggcgtaagctgtcacttttggatggacccgcggcgtattagctagttggtgaggtaacggctcaccaaggcgatgatacgtagccgacctgagagggtgatcggccacattgggactgagacacggcccaaactcctacgggaggcagcagtagggaatcttccacaatggacgaaagtctgatggagcaacnccncgtgagtgaagaaggttttcggatcgtaaaactctgttattggagaagaacgtatttggtagtaactggccagatagtgacggtatccaatcagaaagccacggctaactacgtgccagcagccgcggtaatacgtaggtggcaagcgttgtccggatttattgggcgtaaagcgagtgcaggcggttttttaagtctgatgtgaaagccttcggcttaaccgaagaaatgcattggaaactgggaaacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacagnattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgccaatcctagagataggacgttcccttcggggacgctaagacaggtggtgcatggttgtcgtcagctcgtgtcgtgagatgttgggttaagtcccgcaacgagcgcaacccttattatcagttgccagcatttagttgggcactctggtgagactgccggtgacaaaccggaggaaggtggggatgacgtcaaatcatcatgccccttatgacctgggctacacacgtgctacaatggctagtacaacgagttgcgagaccgcgaggtcaagctaatctctaaaagctagtctcagttcggattgtaggctgcaactcgcctacatgaagttggaatcgctagtaatcgcggatcagcacgccgcggtgaatacgttcccgggccttgtacacaccgcccgtcacaccatgagagtttgtaacacccgaagccggtggagtaacccgtaagggagctagccgtct

SEQ ID NO: 1082 - DNA, 1517 bp, Lactobacillus farciminis
  modified_base (1)..(2): a, c, t, g, unknown or other
  modified_base (154)..(154): a, c, t, g, unknown or other
  modified_base (297)..(297): a, c, t, g, unknown or other
  modified_base (360)..(361): a, c, t, g, unknown or other
  modified_base (551)..(552): a, c, t, g, unknown or other
  modified_base (571)..(571): a, c, t, g, unknown or other
  modified_base (761)..(761): a, c, t, g, unknown or other
  modified_base (956)..(958): a, c, t, g, unknown or other
  modified_base (993)..(993): a, c, t, g, unknown or other
  modified_base (1136)..(1136): a, c, t, g, unknown or other
  modified_base (1410)..(1410): a, c, t, g, unknown or other
  modified_base (1414)..(1414): a, c, t, g, unknown or other
  modified_base (1428)..(1430): a, c, t, g, unknown or other
nntaatatgagagtttgatcctggctcaggacgaacgctggcggcatgcctaatacatgcaagtcgaacgaaccatcctgaagattgaagcttgcttcatgattcagaccttggtgagtggcggacgggtgagtaacacgtgggtaacctgccnaaaagtgggggataacatttggaaacaagtgctaataccgcataacaactactttcacatgatcgtagcttgaaagatggctctgctatcgcttttggatggacccgcggcgtattagctagttggtgaggtaatagctcacnaaggcaatgatacgtagccgacctgagagggtaatcggccacattgggactgagacacggccnnaactcctacgggaggcagcagtagggaatcttccacaatgggcgaaagcctgatggagcaatgccgcgtgagtgaagaaggttttcggatcgtaaaactctgttgttgaagaagaacatgcgtgagagtaactgttcacgtactgacggtattcaaccagaaagctacggctaactacgtgccagcagcnncggtaatacgtaggtggcnagcgttgtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggcnttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggnnngcacaagcggtggagcatgtggtttaattcgaagnaacgcgaagaaccttaccaggtcttgacataccatgacaaactaagagattagtctttcccttcggggacatggatacaggtggtgcatggttgtcgtcagctcgtgtcgtgagatgttgggttaagtcccgcaacgagcgcnacccttattatcagttgccagcattcagttgggcactctggtgagactgccggtgacaaaccggaggaaggtggggacgacgtcaaatcatcatgccccttatgacctgggctacacacgtgctacaatggtcggtacaacgtgttgcgaactcgcgagggcaagcaaatcacttaaaaccgatctcagttcggattgcaggctgcaactcgcctgcatgaagctggaatcgctagtaatcgcggatcagcatgccgcggtgaatacgttcccnggcnttgtacacaccgcnnntcacaccatgagagtttgtaacacccaaagtcggtggggtaacccttcggggaactagccgcctaaggtgggacaaatgattagggt

SEQ ID NO: 1083 - DNA, 1419 bp, Lactobacillus fermentum
  modified_base (1405)..(1405): a, c, t, g, unknown or other
tggcccaattgattgatggtgcttgcacctgattgattttggtcgccaacgagtggcggacgggtgagtaacacgtaggtaacctgcccagaagcgggggacaacatttggaaacagatgctaataccgcataacagcgttgttcgcatgaacaacgcttaaaagatggcttctcgctatcacttctggatggacctgcggtgcattagcttgttggtggggtaatggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaacttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctagtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcatccaaccttaccaggtcttgacatcttgcgcccaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtanccttttaggagcca

SEQ ID NO: 1084 - DNA, 995 bp, Lactobacillus gasseri
  modified_base (43)..(43): a, c, t, g, unknown or other
  modified_base (50)..(50): a, c, t, g, unknown or other
  modified_base (918)..(918): a, c, t, g, unknown or other
  modified_base (976)..(976): a, c, t, g, unknown or other
  modified_base (984)..(984): a, c, t, g, unknown or other
gagcttgcctagatgaatttggtgcttgcaccaaatgaaactngatacangcgagcggcggacgggtgagtaacacgtgggtaacctgcccaagagactgggataacacctggaaacagatgctaataccggataacaacactagacgcatgtctagagtttaaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggnttaattcgaagcaacgcgaagaaccttaccaggtcttgacatccagtgcaaacctaanagattagnagttcccttcg

SEQ ID NO: 1085 - DNA, 1373 bp, Lactobacillus gastricus
tatatggagtttgatcctggctcaggatgaacgccggcggtgtgcctaatacatgcaagtcgaacgagtggcggacgggtgagtaacacgtaggtaacctgcccagaagcgggggataacatctggaaacaggtgctaataccgcataacaaaagtcacttctggatggacctgcggcgcattagcttgttggtagggtaatggcctaccaaggcagtgatgcgtagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttgaagaagatgacggtattcaaccagaaagtcacggctaactacgtgccagcagccgcggtaatacgtaggtggcaagcgttatccggatttattgggcgtaaagagagtgcaggcggtttcttaagtctgatgtgaaagccttcggctcaaccgaagaagtgcatcggaaactgggagacttgagtacagaagagggcagtggaactccatgtgtagcggtggaatgcgtagatatatggaagaacaccagtggcgaaggcggctgcctggtctgactgacgctgagactcgaaagcatgggtagcgaacaggattagataccctggtagtccatgccgtaaacgatgagtgctaggtgttggagcttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagcaaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgtaacacccaaagtcggtgggtagccagccgcctaaggtgggacagatgattagggtgaagtcgtaacaaggtagccgtaggagaacctgcggctggatcacctcctttct

SEQ ID NO: 1086 - DNA, 1287 bp, Lactobacillus sp.
  C1
agtggcgaactggtgagtaacacgtgggtaacctgccctgaagtgggggataacacttggaaacaggtgctaataccgcataacgaaagtcacttttggatggacccgcggcgtattagcttgttggtgaggtaacggctcaccaaggccatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagatgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagggcatcggaaaccgggagacttgagtgcagaagaggacagtggaactccatgtgtagcggtgaaatgcgtagatatatggaagaacaccagtggcgaaggcggctgtctggtctgactgacgctgaggctcgaaagcatgggtagcgaacaggattagataccctggtagtccatgccgtaaacgatgagtgctaagtgttggagcttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcgacaggtggtgcatggttgtcgtcagctcgtgtcgtgagatgttgggttaagtcccgcaacgagcgcaacccttattgtcagttgccagcatgggcactctggcgagactgccggtgacaaaccggaggaaggtggggatgacgtcaaatcatcatgccccttatgacctgggctacacacgtgctacaatggacggcaacgagtcgcgaaaccgcgaggtcaagctaatctcttccgttctcagttcggatgccggctgcaactcgcctgcagaagttggaatcgctagtaatcgtggatcagcatgccacggtgaatacgttcccgggccttgtacacaccgcccgtcacaccatgagagtttgtaacacccaaagccggtaggtaaccagccgtctaaggtgggacagatgattagggtgaagtcgtaacaaggtagccgtaggagaacctgc

SEQ ID NO: 1087 - DNA, 1254 bp, Lactobacillus sp.
  C2
agtggcgaactggtgagtaacacgtgggtaacctgccctgaagtaggggataacacttggaaacaggtgctaataccgtataacaaaagtcactttaggatggacccgcggcgtattagcttgttggtgaggtaacggctcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagatgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgactgacgctgaggctcgaaagcatgggtagcgaacaggattagataccctggtagtccatgccgtaaacgatgagtgctaagtgttggagcttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcgacaggtggtgcatggttgtcgtcagctcgtgtcgtgagatgttgggttaagtcccgcaacgagcgcaacccttattgttagttgccagcatgggcactctagcaagactgccggtgacaaaccggaggaaggtggggatgacgtcaaatcatcatgccccttatgacctgggctacacacgtgctacaatggacggcaacgagtcgcgaaaccgcgaggtcaagctaatctcttccgttctcagttcggatgtaggctgcaactcgcctacagaagttggaatcgctagtaatcgtggatcagcatgccacggtgaatacgttcccgggccttgtacacaccgcccgtcacaccatgagagtttgtaacacccaaagccggtaggtaaccagccgtctaaggtgggacagatgattagggtg

SEQ ID NO: 1088 - DNA, 1016 bp, Lactobacillus helveticus
  modified_base (797)..(799): a, c, t, g, unknown or other
  modified_base (979)..(979): a, c, t, g, unknown or other
  modified_base (983)..(986): a, c, t, g, unknown or other
  modified_base (1000)..(1000): a, c, t, g, unknown or other
gtcgagcgagcagaaccagcagatttacttcggtaatgacgctggggacgcgagcggcggatgggtgagtaacacgtggggaacctgccccatagcctgggataccacttggaaacaggtgctaataccggataagaaagcagatcgcatgatcagcttataaaaggcggcgtaagctgtcgctatgggatggccccgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaattccatgtgtagcggtggaatgcgtagatatatggaagaacaccagtggcgaaggcgactctctggtctgcaactgacgctgaggctcgaaagcatgggtagcgaacaggattagataccctggtagtccatgccgtaaacgatgagtgctaagtgttnnnggtttccgcctctcagtgctgcagctaacgcatttaagcactccgcctggggagtacgaccgcaaggttgaaactcaaaggaattgacgggggcccgcacaagcggtggagcatgtggtttaattcgaagcaacgcgaagaacccttaccaggtcttgacatctagtgccatcctaaganattnnnnttcccttcggggangctaagacaggtggtg

SEQ ID NO: 1089 - DNA, 1572 bp, Lactobacillus hilgardii
tgagagtttgatcctggctcaggacgaacgctggcggcgtgcctaatacatgcaagtcgaacgcgtcttggtcaatgaagttgagtgcttgcatttaactgatttgacattaagacgagtggcgaactggtgagtaacacgtgggtaacttgccccgaagcgggggataacatttggaaacaggtgctaataccgcataacaacaaaaaccacatggtttttgtttaaaagatggtttcggctatcactttgggatggacccgcggcgtattagctagttggtgaggtaatggctcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacgggtgtcagagtaactgttgacatcgtgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgctaacctaagagattaggcgttcccttcggggacggaatgacaggtggtgcatggttgtcgtcagctcgtgtcgtgagatgttgggttaagtcccgcaacgagcgcaacccttattgtcagttgccagcatttagttgggcactctggcgagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccgggccttgtacacaccgcccgtcacaccatgagagtttgtaacacccaaagccggtgaggtaaccttcgggggccagccgtctaaggtgggacagatgattagggtgaagtcgtaacaaggtagccgtaggagaacctgcggctggatcacctcctttcta

SEQ ID NO: 1090 - DNA, 1718 bp, Lactobacillus hominis
tacacatggagttccactctcctcttctgcactcaagttcaacagtttctgatgcaattctccggttgagccgaaggctttcacatcagacttattgaaccgcctgcactcgctttacgcccaataaatccggacaacgcttgccacctacgtagagtttgatcatggctcaggacgaacgctggcggcgtgcctaatacatgcaagtcgagcgagcttgcctagatgatttcggtgcttgcaccgaatgaaactagatacaagcgagcggcggacgggtgagtaacacgtgggtaacctgcccaagagactgggataacacctggaaacagatgctaataccggataacaacatctagcgcatgctagaagtttgaaagatgggtttctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttggtggtgaagaaagatagaggtagtaactggcctttatttgacggtaatcacctagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggtgttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctctgaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgagataaccattaaaggagtcagccgtctaaggtaggacagatgattagggtgaagtcgtaacaaggtagccgtaggagaacctgcggttggatcacctcctta

SEQ ID NO: 1091 - DNA, 1572 bp, Lactobacillus iners
aaattgagagtttgatcctggctcaggacgaacgctggcggcgtgcctaatacatgcaagtcgagcgagtctgccttgaagatcggagtgcttgcactctgtgaaacaagatacaggctagcggcggacgggtgagtaacacgtgggtaacctgcccaagagatcgggataacacctggaaacagatgctaataccggataataacagatgatgcctatcaactgtttaaaagatggttctgctatcactcttggatggacctgcggtgcattagctagttggtagggtaacggcctaccaaggcgatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttgttggtgaagaaggacaggggtagtaactgacctttgtttgacggtaatcaattagaaagtcacggctaactacgtgccagcagccgcggtaatacgtaggtggcaagcgttgtccggatttattgggcgtaaagcgagtgcaggcggctcgataagtctgatgtgaaagccttcggctcaaccggagaattgcatcagaaactgtcgagcttgagtacagaagaggagagtggaactccatgtgtagcggtgaaatgcgtagatatatggaagaacaccggtggcgaaggcggctctctggtctgttactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccatagccagtctaagagattagatgttcccttcggggactatgagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacacacgtgctacaatggacggtacaacgagaagcgaccctgtgaaggcaagcggatctctgaaagccgttctcagttcggattgcaggctgcaactcgcctgcatgaagctggaatcgctagtaatcgcaaatcagcacgttgcggtgaatacgttcccgggccttgtacacaccgcccgtcacaccatgagagtctgtaacgcccgaagccggcgggataaccgaaaggagtcagccgtctaaggcgggacagatgattagggtgaagtcgtaacaaggtagccgtaggagaacctgcggctggatcacctcctttct

SEQ ID NO: 1092 - DNA, 1567 bp, Lactobacillus jensenii
ttcaaaatgagagtttgatcctggctcaggacgaacgctggcggcgtgcctaatacatgcaagtcgagcgagcttgcctatagaaattcttcggaatggacatagatacaagctagcggcggatgggtgagtaacgcgtgggtaacctgcccttaagtctgggataccatttggaaacagatgctaataccggataaaagctactttcgcatgaaagaagtttaaaaggcggcgtaagctgtcgctaaaggatggacctgcgatgcattagctagttggtaaggtaacggcttaccaaggcgatgatgcatagccgagttgagagactgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggattgataagtctgatgtgaaagccttcggctcaaccgaagaactgcatcagaaactgtcaatcttgagtgcagaagaggagagtggaactccatgtgtagcggtggaatgcgtagatatatggaagaacaccagtggcgaaggcggctctctggtctgtaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccacctaagagattaggttttcccttcggggacaaagagacaggtggtgcatggctgtcgtcagctcgtgtcgtgagatgttgggttaagtcccgcaacgagcgcaacccttgttaatagttgccagcattaagttgggcactctattgagactgccggtgacaaaccggaggaaggtggggatgacgtcaagtcatcatgccccttatgacctgggctacacacgtgctacaatgggcagtacaacgagaagcgaacctgtgaaggcaagcggatctcttaaagctgttctcagttcggactgtaggctgcaactcgcctacacgaagctggaatcgctagtaatcgcggatcagcacgccgcggtgaatacgttcccgggccttgtacacaccgcccgtcacaccatgagagtttgtaacacccaaagtcggtgaggtaacctttggagccagccgcctaaggtgggacagatgattagggtgaagtcgtaacaaggtagccgtaggagaacctgcggctggatcacctcctttct

SEQ ID NO: 1093 - DNA, 1651 bp, Lactobacillus johnsonii
agctaaacgataaaaagctcattttcaaaaggaaaatgagagtttgatcctggctcaggacgaacgctggcggcgtgcctaatacatgcaagtcgagcgagcttgcctagatgattttagtgcttgcactaaatgaaactagatacaagcgagcggcggacgggtgagtaacacgtgggtaacctgcccaagagactgggataacacctggaaacagatgctaataccggataacaacactagacgcatgtctagagtttgaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgaaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggtgttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctcttaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgggataacctttataggagtcagccgtctaaggtaggacagatgattagggtgaagtcgtaacaaggtagccgtaggagaacctgcggctggatcacctcctttctaaggaaggcgaaagatgatggagagtgcgagagcactaagagaag

SEQ ID NO: 1094 - DNA, 1555 bp, Lactobacillus kalixensis
ttgatcctggctcaggacgaacgctggcggcgtgcctaatacatgcaagtcgagcgaacagaagcagcagaattacttcggtaaggacgctgtggaagttagcggcggatgggtgagtaacacgtgggtaacctacccttaagactgggataccacttggaaacaggtgctaataccggataggagtatgagctgcatggcttatactttaaaggcggcgaaagctgtcactaaaggatggacccgcggtgcattagctagttggtaaggtaacggcttaccaaggcgacgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatataggtagtaactggcctatatttgacggtaatcaaccagaaagtcacggctaactacgtgccagcagccgcggtaatacgtaggtggcaagcgttgtccggatttattgggcgtaaagcgagcgcaggcggagaaataagtctgatgtgaaagcccacggctcaaccgtggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccattctaagagattagaagttcccttcggggacgctaagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacacacgtgctacaatgggcagtacaacgagaagcaagccggtgacggcaagcgaatctcttaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccgtaaggaaggagccgtctaaggcagggcagatgactggggtgaagtcgtaacaaggtagccgtaggagaacctgcggctggatcacctccttttct

SEQ ID NO: 1095 - DNA, 1552 bp, Lactobacillus kefiranofaciens
agtttgattcttgctcaggacgaacgctggcggcgtgcctaatacatgcaagtcgagcgagcggaaccagcagaatcacttcggtgaggacgctgggaaagcgagcggcggatgggtgagtaacacgtggggaacctgcccttaagtctgggataccacttggaaacaggtgctaataccggataagaaagcagttcgcatgaacagcttttaaaaggcggcgcaagctgtcgctaaaggatggacccgcggtgcattagctagttggtaaggtaacggcctaccaaggcagtgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggaccgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaattgcatcggaaactgtttttcttgagtgcagaagaggagagtagaactccatgtgtagcggtggaatgcgtagatatatggaagaataccagtggcgaaggcggctctctggtctgcaactgacgctgaggctcgaaagcatgggtagcgaacaggattagataccctggtagtccatgccgtaaacgatgagtgctaagtgttgggaggcttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccatttgtagagatacaaagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagcacaacgagcagcgagcctgcaaaggcaagcaaatctctgaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccgcaaggaaggagccgtctaaggcagggcagatgactggggtgaagtcgtaacaaggtagccgtaggagaacctgcggctggatcacctct

SEQ ID NO: 1096 - DNA, 1456 bp, Lactobacillus kefiri
gtcgaacgcgtttccgttattgattttaggtgcttgcatttagaatgatttaacacggaaacgagtggcgaactggtgagtaacacgtgggtaacctgcccttgaagtaggggataacacttggaaacaggtgctaataccgtataacaaccaaaaccacatggttttggtttaaaagatggcttcggctatcactttaggatggacccgcggcgtattagcttgttggtaaggtaatggcctaccaaggcaatgatacgtagccgacctgagagggtaatcggccacattgggactgagacacggcccaaactcctacgggaggcagcagtatggaatcttccacaatggacgaaagtctgatggagcaacgccgcgtgagtgatgaagggtttcggctcgtaaaactctgttgttggagaagaacaggtgtcagagtaactgttgacatcttgacggtatccaaccagaaagccacggctaactacgtgccagcagccgcggtaatacgtaggtggcaagcgttgtccggatttattgggcgtaaagcgagcgcaggcggtttcttaggtctgatgtgaaagccttcggcttaaccggagaagtgcatcggaaaccaggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcattcagttgggcactctagcaagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgcaggctgcaactcgcctgcatgaagttggaatcgctagtaatcgtggatcagcatgccacggtgaatacgttcccgggccttgtacacaccgcccgtcacaccatgagagtttgtaacacccaaagccggtgaggtaaccttcggggaccagccgtctaaggtggacagatga

SEQ ID NO: 1097 - DNA, 1522 bp, Lactobacillus kimchii
gacgaacgctggcggcatgcctaatacatgcaagtcgaacgaaccatcctgaagattgaagcttgcttcatgattcagaccttggtgagtggcggacgggtgagtaacacgtgggtaacctgcccagaagtgggggataacatttggaaacaagtgctaataccgcataacaacttagatcacatgatctttgtttaaaagatggttttgctatctcttctggatggacccgcggcgtattagctagttggtgaggtaatagctcaccaaggcgatgatacgtagccgacctgagagggtaatcggccacattgggactgagacacggcccaaactcctacgggaggcagcagtagggaatcttccacaatggacgaaagtctgatggagcaatgccgcgtgagtgaagaaggttttcggatcgtaaaactctgttgttgaagaagaacatatgtgagagtaactgttcacgtactgacggtattcaaccagaaagccacggctaactacgtgccagcagccgcggtaatacgtaggtggcaagcgttgtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggctttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggcccgcacaagcggtggagcatgtggtttaattcgaagcaacgcgaagaaccttaccaggtcttgacataccatgaaaagcttagagataagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgataaaccggaggaaggtggggacgacgtcaaatcatcatgccccttatgacctgggctacacacgtgctacaatggtcggtacaacgtgctgcgaactcgcgagggcaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagtcggtggggtaacccttcggggaactagccgcctaaggtgggacaaatgattagggtgaagtcgtaacaaggtagccgtaggagaacctgc

SEQ ID NO: 1098 - DNA, 1479 bp, Lactobacillus leichmannii
gacgaacgctggcggcgtgcctaatacatgcaagtcgagcgagctgaattcaaagatcccttcggggtgatttgttggaygctagcggcggatgggtgagtaacacgtgggcaatctgccctaaagactgggataccacttggaaacaggtgctaataccggataacaacatgaatcgcatgattcaagtttgaaaggcggcgcaagctgtcactttaggatgagcccgcggcgcattagctagttggtggggtaaaggcctaccaaggcaatgatgcgtagccgagttgagagactgatcggccacattgggactgagacacggcccaaactcctacgggaggcagcagtagggaatcttccacaatggacgcaagtctgatggagcaacgccgcgtgagtgaagaaggtyttcggatcgtaaagctctgttgttggtgaagaaggatagaggcagtaactggtctttatttgacggtaatcaaccagaaagtcacggctaactacgtgccagcagccgcggtaatacgtaggtggcaagcgttgtccggatttattgggcgtaaagcgagcgcaggcggaatgataagtctgatgtgaaagcccacggctcaaccgtggaactgcatcggaaactgtcattcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagcgctaggtgttggggactttccggtcctcagtgccgcagcaaacgcattaagcgctccgcctggggagtacgaccgcaaggttgaaactcaaaggaattgacgggggcccgcacaagcggtggagcatgtggtttaattcgaagcaacgcgaagaaccttaccaggtcttgacatcctgcgctacacytagagatargtggttcccttcggggacgcagagacaggtggtgcatggctgtcgtcagctcgtgtcgtgagatgttgggttaagtcccgcaacgagcgcaacccttgtctttagttgccatcattaagttgggcactctaaagagactgccggtgacaaaccggaggaaggtggggatgacgtcaagtcatcatgccccttatgacctgggctacacacgtgctacaatgggcagtacaacgagaagcraacccgcgagggtaagcggatctcttaaagctgytctcagttcggactgcaggctgcaactcgcctgcacgaagctggaatcgctagtaatcgcggatcagcacgccgcggtgaatacgttcccgggccttgtacacaccgcccgtcacaccatggaagtctgcaatgcccaaagtcggtgsgataacctttataggagtcagccgcctaaggcagggcagatgac

SEQ ID NO: 1099 - DNA, 1308 bp, Lactobacillus mucosae
agcgagtggcggacgggtgagtaacacgtaggtaacctgccccaaagcgggggataacatttggaaacagatgctaataccgcataacaatttgaatcgcatgattcaaatttaaaagatggcttcggctatcactttgggatggacctgcggcgcattagcttgttggtagggtaacggcctaccaaggctgtgatgcgtagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttagagaagaacgtgcgtgagagcaactgttcacgcagtgacggtatctaaccagaaagtcacggctaactacgtgccagcagccgcggtaatacgtaggtggcaagcgttatccggatttattgggcgtaaagcgagcgcaggcggtttgataagtctgatgtgaaagcctttggcttaaccaaagaagtgcatcggaaactgtcagacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcggaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagtcgcgaactcgcgagggcaagctaatctcttaaaaccgttctcagttcggactgcaggctgcaactcgcctgcacgaagtcggaatcgctagtaatcgcggatcagcatgccgcggtgaatacgttcccgggccttgt

SEQ ID NO: 1100 - DNA, 1022 bp, Lactobacillus murinus
  modified_base (989)..(989): a, c, t, g, unknown or other
  modified_base (998)..(1001): a, c, t, g, unknown or other
  modified_base (1003)..(1004): a, c, t, g, unknown or other
  modified_base (1011)..(1012): a, c, t, g, unknown or other
cttctttatcaccgagtgcttgcactcaccgataaagagttgagtggcgaacgggtgagtaacacgtgggcaacctgcccaaaagagggggataacacttggaaacaggtgctaataccgcataaccatagttaccgcatggtaactatgtaaaaggtggctatgctaccgcttttggatgggcccgcggcgcattagctagttggtgaggtaaaggcttaccaaggcaatgatgcgtagccgaactgagaggttgatcggccacattgggactgagacacggcccaaactcctacgggaggcagcagtagggaatcttccacaatgggcgaaagcctgatggagcaacgccgcgtgggtgaagaaggtcttcggatcgtaaaaccctgttgttagagaagaaagtgcgtgagagtaactgttcacgtttcgacggtatctaaccagaaagccacggctaactacgtgccagcagccgcggtaatacgtaggtggcaagcgttatccggatttattgggcgtaaagggaacgcaggcggtcttttaagtctgatgtgaaagccttcggcttaaccggagtagtgcattggaaactgggagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaagtgttggagggtttccgcccttcagtgctgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcttctgacaatcctagagataggactttcccttcgggganagaatgacnnnngnncatggtnntcgtcagctc

SEQ ID NO: 1101 - DNA, 1556 bp, Lactobacillus nodensis
cctggctcaggacgaacgctggcggcgtgcctaatacatgcaagtcgagcgaactctggtttttgaacgatggtgcttgcaccggagtgattaaacatttgagtgagcggcggatgggtgagtaacacgtgggtaacctgccctaaagtgggggataacatttggaaacaagtgctaataccgcataacaacatttaccacatggtttatgtttgaaagatggttctgctatcgctttaggatggacccgcggtgcattagttagttggtgaggtaacggctcaccaagaccgtgatgcatagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagtaactgttcatgtattgacggtattcaaccagaaagccacggctaactacgtgccagcagccgcggtaatacgtaggtggcaagcgttgtccggatttattgggcgtaaagcgagcgtaggcggtttattaagtctgatgtgaaagccctcggctcaaccgaggaagtgcatcggaaactggtaaacttgagtgcagaagaggagagtggaactccatgtgtagcggtggaatgcgtagatatatggaagaacatcagtggcgaaggcggctctctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatcttgaaacactaagagattagtttttcccttcggggacaagaatacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaccttttaggagctagccgtctaaggtgggacaaatgattagggtgaagtcgtaacaaggtagccgtaggagaacctgcggctggatcacctcctac

SEQ ID NO: 1102 - DNA, 1556 bp, Lactobacillus oeni
tagattttgatcctggctcaggacgaacgctggcggcgtgcctaatacatgcaagtcgaacgcagaatttccaccgagtgcttgcactcaccggaaattctgagtggcgaacgggtgagtaacacgtgggtaacctgcccaaaagagggggataacacttggaaacaggtgctaataccgcataacaacaaaaaccgcctggtttttgtttcaaagatggtttcggctgtcacttttggatggacccgcggcgtattagctagttggtaaggtaacggcttaccaaggcagtgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgttagagaagaacgtgtgtgagagtaactgttcatgcagtgacggtatctaaccagaaagccacggctaactacgtgccagcagccgcggtaatacgtaggtggcaagcgttgtccggatttattgggcgtaaagggaacgcaggcggtcttttaagtctgatgtgaaagccttcggcttaaccgaagtcgtgcattggaaactgagagacttgagtgcagaagaggagagtggaactccatgtgtagcggtgaaatgcgtagatatatggaagaacaccagtggcgaaagcggctctctggtctgtaactgacgctgaggttcgaaagcatgggtagcaaacaggattagataccctggtagtccatgccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgctaacctgagagatcaggcgttcccttcggggacaaaatgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggatgacgtcaaatcatcatgccccttatgacctgggctacacacgtgctacaatggacggtacaacgagtcgcgaaaccgcgaggtttagctaatctcttaaaaccgttctcagttcggattgcaggctgcaactcgcctgcatgaagtcggaatcgctagtaatcgcggatcagcatgccgcggtgaatacgttcccgggccttgtacacaccgcccgtcacaccatgagagtttgtaacacccaaagccggtgcggtaaccttttaggaaccagccgtctaaggtgggacagatgattggggtgaagtcgtaacaaggtagccgtaggagaacctgcggctggaccacctacttaa

SEQ ID NO: 1103 - DNA, 1579 bp, Lactobacillus oris
ttttatatgagagtttgatcctggctcaggatgaacgccggcggtgtgcctaatacatgcaagtcgagcgcactggcccaacagaaatgacgtgcttacactgatttgacgttggattcccagtgagcggcggacgggtgagtaacacgtgggcaacctgccccaaagcgggggataacatttggaaacaggtgctaataccgcataacttggaaaaccacatggttttccaataaaagatggtttcggctatcactttgggatgggcccgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaaactctgttgttggagaagaacgtgcgtaagagtaactgtttacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccgaagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaacctcagagatgaggcgttcccttcggggacgcaaagacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggccggtacaacgagcagctaacccgcgagggtgtgcaaatctcttaaagccggtctcagttcggactgcagtctgcaactcgactgcacgaagtcggaatcgctagtaatcgcggatcagcatgccgcggtgaatacgttcccgggccttgtacacaccgcccgtcacaccatggaagtttgtaacgcccaaagtcggtggcctaaccatttggagggagccgcctaaggcgggacagatgactggggtgaagtcgtaacaaggtagccgtaggagaacctgcggctggatcacctcctttct

SEQ ID NO: 1104 - DNA, 1518 bp, Lactobacillus parabrevis
gacgaacgctggcggcatgcctaatacatgcaagtcgaacgagcttccgttgaatgacgtgcttgcactgatttyaacaatgaagcgagtggcgaactggtgagtaacacgtgggtaacttgcccagaagcaggggataacacttggaaacaggtgctaataccgtataacaacagaaaccgcatggtttctgtttgaaaggtggtttcggctatcacttctggatggacccgcggcgtattagttagttggtgaggtaaaggcccaccaagacaatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacactcttgagagtaactgttcaggagttgacggtatttaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatactatgcaaatcctagagataggacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggacggtacaacgagtygcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacc

SEQ ID NO: 1105 - DNA, 1556 bp, Lactobacillus parabuchneri
ttgatcctggctcaggacgaacgctggcggcgtgcctaatacatgcaagtcgaacgcgtcttggttattgatgttaagtgcttgcatttaactgatttaacattgagacgagtggcgaactggtgagtaacacgtgggtaacctgcccttgaagtaggggataacacttggaaacaggtgctaataccgtataacaaccaaaaccacctggttttggtttaaaagatggcttcggctatcactttaggatggacccgcggcgtattagcttgttggtaaggtaacggcctaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacaggtgtgagagtaactgttcacatcttgacggtatccaaccagaaagccacggctaactacgtgccagcagccgcggtaatacgtaggtggcaagcgttgtccggatttattgggcgtaaagcgagcgcaggcggtttcttaggtctgatgtgaaagccttcggcttaaccggagaagtgcatcggaaaccaggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcattcagttgggcactctagcaagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccgggccttgtacacaccgcccgtcacaccatgagagtttgtaacacccaaagccggtgaggtaaccttcggggaccagccgtctaaggtgggacagatgattagggtgaagtcgtaacaaggtagccgtaggagaacctgcggctggatcac

SEQ ID NO: 1106 - DNA, 1410 bp, Lactobacillus paracasei
  modified_base (1402)..(1402): a, c, t, g, unknown or other
tcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggacatgtggtttaattcgaagcaacgcgaagaacttaccaggtcttgacatcttttgatcacctgagagatcccgttacccattggggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaaccctntagggagc

SEQ ID NO: 1107 - DNA, 1396 bp, Lactobacillus parakefiri
  modified_base (51)..(51): a, c, t, g, unknown or other
gacgaacgctggcggcgtgcctaatacatgcaagtcgaacgcgtcttggcnaatgattttaggtgcttgcacttgaaagatttgacattgagacgagtggcgaactggtgagtaacacgtgggtaacctgcccttgaagtaggggataacacttggaaacaggtgctaataccgtataacaaccaaaaccacctggttttggtttaaaagacggcttcggctgtcactttaggatggacccgcggcgtattagcttgttggtaaggtaacggcctaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaaccgttgtcagagcaactgttgacagcttgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcattcagttgggcactctagcaagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccggcctt

SEQ ID NO: 1108 - DNA, 1308 bp, Lactobacillus pentosus
gagtttgatcatggctcaggacgaacgctggcggcgtgcctaatacatgcaagtcgaacgagtggcgaactggtgagtaacacgtgggaaacctgcccagaagcgggggataacacctggaaacagatgctaataccgcataacgaaagtcacttttggatggtcccgcggcgtattagctagatggtgaggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagatgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgactgacgctgaggctcgaaagtatgggtagcaaacaggattagataccctggtagtccataccgtaaacgatgaatgctaagtgttggagcttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatatacaggtggtgcatggttgtcgtcagctcgtgtcgtgagatgttgggttaagtcccgcaacgagcgcaacccttattatcagttgccagcatgggcactctggtgagactgccggtgacaaaccggaggaaggtggggatgacgtcaaatcatcatgccccttatgacctgggctacacacgtgctacaatggatggcaacgagttgcgaactcgcgagagtaagctaatctcttccattctcagttcggatgtaggctgcaactcgcctacagaagtcggaatcgctagtaatcgcggatcagcatgccgcggtgaatacgttcccgggccttgtacacaccgcccgtcacaccatgagagtttgtaacacccaaagtcggtgggtaaccagccgcctaaggtgggacagatgatt

SEQ ID NO: 1109 - DNA, 1554 bp, Lactobacillus perolens
tggctcaggacgaacgctggcggcgtgcctaatacatgcaagtcgaacgaggtttgatcagtttgcggtggtgcttgcatcaccaattaccgattaaaccgagtggcggacgggtgagtaacacgtgggtaacctgcccttcagcaggggataacatttggaaacagatgctaataccgtataaccacggagaccgcatggtctccgggtaaaagatggcgaaagctatcactgagggatggacccgcggcgtattagccagttggtggggtaatggcctaccaaagcgatgatacgtagccgacctgagagggtaatcggccacattgggactgagacacggcccaaactcctacgggaggcagcagtagggaatcttccacaatggacgcaagtctgatggagcaacgccgcgtgagtgaagaaggctttcgggtcgtaaaactctgttattgaagaagaacgtgtgtgagagtaactgctcatgcagtgacggtattcaaccagaaagtcacggctaactacgtgccagcagccgcggtaatacgtaggtggcaagcgttgtccggatttattgggcgtaaagcgagtgcaggcggttttttaagtctgatgtgaaagccttcggcttaaccgaagaagtgcatcggaaagtgggaaacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacaggattagataccctggtagtccacgccgtaaacgatgaatactaagtgttggggggtttccgcccctcagtgctgcagctaacgcattaagtattccgcctggggagtacgaccgcaaggttgaaactcaaaggaattgacgggggcccgcacaagcggtggagcatgtggtttaattcgaagcaacgcgaagaaccttaccaggtcttgacatcttctgccaagctgagagatcagccgttccttcggggacagaatgacaggtggtgcatggttgtcgtcagctcgtgtcgtgagatgttgggttaagtcccgcaacgagcgcaacccttatgattagttgccagcattcagttgggcactctagtcagactgccggtgacaaaccggaggaaggcggggatgacgtcaaatcatcatgccccttatgacctgggctacacacgtgctacaatgggtggtacaacgagcagcgagaccgcgaggtcaagcgaatctctaaaaaccatcctcagttcggattgtaggctgcaactcgcctacatgaagctggaatcgctagtaatcgcggatcagcacgccgcggtgaatacgttcccgggccttgtacacaccgcccgtcacaccatgagagtttgtaacacccaaagccggtaggacaaccgcaaggagtcagccgtctaaggtgggacaaatgattagggtgaagtcgtaacaaggtagccgtaggagaacctgcggctggatcacctcctttct

SEQ ID NO: 1110 - DNA, 900 bp, Lactobacillus plantarum
  modified_base (19)..(19): a, c, t, g, unknown or other
  modified_base (32)..(32): a, c, t, g, unknown or other
  modified_base (44)..(44): a, c, t, g, unknown or other
  modified_base (74)..(74): a, c, t, g, unknown or other
  modified_base (87)..(87): a, c, t, g, unknown or other
  modified_base (99)..(99): a, c, t, g, unknown or other
  modified_base (123)..(123): a, c, t, g, unknown or other
  modified_base (133)..(134): a, c, t, g, unknown or other
  modified_base (151)..(151): a, c, t, g, unknown or other
  modified_base (153)..(153): a, c, t, g, unknown or other
  modified_base (203)..(203): a, c, t, g, unknown or other
  modified_base (382)..(382): a, c, t, g, unknown or other
  modified_base (882)..(884): a, c, t, g, unknown or other
  modified_base (886)..(888): a, c, t, g, unknown or other
gccgcggtaatacgtaggngcaagcgttgtcnggattattgggngtaaagcgagcgcaggcggttttttaagtntgatgtgaaagcnttcggctcaacngaagaagtgcatcggaaaactggnaaacttgagnncagaagaggacagtggnanctccatgtgtagcggtgaaatgcgtagatatatggaagaacaccagtggngaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggntgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccnnnannncatgagagtttg

SEQ ID NO: 1111 - DNA, 1395 bp, Lactobacillus pontis
agtgagcggcggacgggtgagtaacacgtgggcaacctgccctggagcgggggataacatttggaaacagatgctaataccgcataataatcaaaaccacatggttttgatttcaaagatggcttcggctatcactccaggatgggcccgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaaactctgttgttgaagaagaacgtgcgtgagagtaactgttcatgcagtgacggtattcaaccagaaagtcacggctaactacgtgccagcagccgcggtaatacgtaggtggcaagcgttatccggatttattgggcgtaaagcgagcgcaggcggttacttaagtctgatgtgaaagccttcggcttaaccgaagaagtgcatcggaaactgggtgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaacctaagagattaggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggatgacgtcagatcatcatgccccttatgacctgggctacacacgtgctacaatggtcggtacaacgagtcgctaacccgcgagggcaagctaatctcttaaagccgatctcagttcggactgtaggctgcaactcgcctacacgaagtcggaatcgctagtaatcgcggatcagcatgccgcggtgaatacgttcccgggccttgtacacaccgcccgtcacaccatggaagtttgtaacgcccaaagtcggtggcctaaccatttggagggagccgcctaaggcgggacagat

SEQ ID NO: 1112 - DNA, 1580 bp, Lactobacillus reuteri
ttttatatgagagtttgatcctggctcaggatgaacgccggcggtgtgcctaatacatgcaagtcgtacgcactggcccaactgattgatggtgcttgcacctgattgacgatggattaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcggggacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaagctcgcgagagtaagctaatctcttaaagccgttctcagttcggactgtaggctgcaactcgcctacacgaagtcggaatcgctagtcctcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtaggagaacctgcggctggatcacctcctttct

SEQ ID NO: 1113 - DNA, 1429 bp, Lactobacillus rhamnosus
gtcgaacgagttctgattattgaaaggtgcttgcatcttgatttaattttgaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactgggaaacttgagtgcagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctagtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggttgcccgtgtggggcgaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgt

SEQ ID NO: 1114 - DNA, 1452 bp, Lactobacillus rogosae
tcaggatgaacgctggcggcgtgcttaacacatgcagtcgaacgaagcatttaagacagattacttcggtttgaagtcttttatgactgagtggcggacgggtgagtaacgcgtgggtaacctgcctcatacagggggatagcagctggaaacggctggtaataccgcataagcgcacagtaccacatggtacagtgtgaaaaactccggtggtatgagatggacccgcgtctgattagcttgttggcggggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggcacataagtgctccggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggtcagtaatgtgaccttttcttcggaacaagagtgacaggtggtgcatggttgtcgtcagctcgtgtcgtgagatgttgggttaagtcccgcaacgagcgcaacccttatccttagtagccagcagttcggctgggcactctagggagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagtcggtgacctaacgtaagaagagccgccgaagcaggtctgataactggg

SEQ ID NO: 1115 - DNA, 1561 bp, Lactobacillus ruminis
ttgagagtttgatcctggctcaggacgaacgctggcggcgtgcctaatacatgcaagtcgaacgaagctttctttcaccgaatgcttgcattcaccgaaagaagcttagtggcgaacgggtgagtaacacgtaggcaacctgcccaaaagagggggataacacttggaaacaggtgctaataccgcataaccatgaacaccgcatgatgttcatgtaaaagacggcttttgctgtcacttttggatgggcctgcggcgtattaacttgttggtggggtaacggcctaccaaggtgatgatacgtagccgaactgagaggttgatcggccacattgggactgagacacggcccaaactcctacgggaggcagcagtagggaatcttccacaatggacgaaagtctgatggagcaacgccgcgtgaatgaagaaggccttcgggtcgtaaaattctgttgtcagagaagaacgtgcgtgagagtaactgttcacgtattgacggtatctgaccagaaagccacggctaactacgtgccagcagccgcggtaatacgtaggtggcgagcgttgtccggatttattgggcgtaaagggaacgcaggcggtcttttaagtctgatgtgaaagccttcggcttaaccgaagtagtgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcttctgacaattccagagatggaacgttcccttcggggacagaatgacaggtggtgcatggttgtcgtcagctcgtgtcgtgagatgttgggttaagtcccgcaacgagcgcaacccttattgtcagttgccatcattaagttgggcactctggcgagactgccggtgacaaaccggaggaaggtggggatgacgtcaaatcatcatgccccttatgacctgggctacacacgtgctacaatggacggtacaacgagtcgctaactcgcgagggcaagctaatctcttaaagccgttctcagttcggattgcaggctgcaactcgcctgcatgaagtcggaatcgctagtaatcgcgaatcagcatgtcgcggtgaatacgttcccgggccttgtacacaccgcccgtcacaccatgagagtttgtaacacccaaagtcggtggggtaaccttttggagccagccgcctaaggtgggacagatgattggggtgaagtcgtaacaaggtagccgtaggagaacctgcggctggatcacctcctttct

SEQ ID NO: 1116 - DNA, 1579 bp, Lactobacillus sakei
gggaattcgattgagtttgatcctggctcaggacgaacgctggcggcgtgcctaatacatgcaagtcgaacgcactctcgtttagattgaaggagcttgctcctgattgataaacatttgagtgagtggcggacgggtgagtaacacgtgggtaacctgccctaaagtgggggataacatttggaaacagatgctaataccgcataaaacctaacaccgcatggtgtagggttgaaagatggtttcggctatcactttaggatggacccgcggtgcattagttagttggtgaggtaaaggctcaccaagaccgtgatgcatagccgacctgagagggtaatcggccacactgggactgagacacggcccagactcctacgggaggcagcagtagggaatcttccacaatggacgaaagtctgatggagcaacgccgcgtgagtgaagaaggttttcggatcgtaaaactctgttgttggagaagaatgtatctgatagtaactgaccaggtagtgacggtatccaaccagaaagccacggctaactacgtgccagcagccgcggtaatacgtaggtggcaagcgttgtccggatttattgggcgtaaagcgagcgcaggcggtttcttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggatggtacaacgagttgcgagaccgcgaggtttagctaatctcttaaaaccattctcagttcggattgtaggctgcaactcgcctacatgaagccggaatcgctagtaatcgcggatcagcatgccgcggtgaatacgttcccgggccttgtacacaccgcccgtcacaccatgagagtttgtaacacccaaagccggtgaggtaaccttcggggagccagccgtctaaggtgggacagatgattagggtgaagtcgtaacaaggtagccgtaggagaacctgcggctggatcacctcctttct

SEQ ID NO: 1117 - DNA, 1566 bp, Lactobacillus salivarius
tttaaaatgagagtttgatcctggctcaggacgaacgctggcggcgtgcctaatacatgcaagtcgaacgaaactttcttacaccgaatgcttgcattcaccgtaagaagttgagtggcggacgggtgagtaacacgtgggtaacctgcctaaaagaaggggataacacttggaaacaggtgctaataccgtatatctctaaggatcgcatgattcttagatgaaagatggttctgctatcgcttttagatggacccgcggcgtattaactagttggtggggtaacggcctaccaaggtgatgatacgtagccgaactgagaggttgatcggccacattgggactgagacacggcccaaactcctacgggaggcagcagtagggaatcttccacaatggacgcaagtctgatggagcaacgccgcgtgagtgaagaaggtcttcggatcgtaaaactctgttgttagagaagaacacgagtgagagtaactgttcattcgatgacggtatctaaccagcaagtcacggctaactacgtgccagcagccgcggtaatacgtaggtggcaagcgttgtccggatttattgggcgtaaagggaacgcaggcggtcttttaagtctgatgtgaaagccttcggcttaaccggagtagtgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaggtgttggagggtttccgcccttcagtgccgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcctttgaccacctaagagattaggctttcccttcggggacaaagtgacaggtggtgcatggctgtcgtcagctcgtgtcgtgagatgttgggttaagtcccgcaacgagcgcaacccttgttgtcagttgccagcattaagttgggcactctggcgagactgccggtgacaaaccggaggaaggtggggacgacgtcaagtcatcatgccccttatgacctgggctacacacgtgctacaatggacggtacaacgagtcgcgagaccgcgaggtttagctaatctcttaaagccgttctcagttcggattgtaggctgcaactcgcctacatgaagtcggaatcgctagtaatcgcgaatcagcatgtcgcggtgaatacgttcccgggccttgtacacaccgcccgtcacaccatgagagtttgtaacacccaaagccggtggggtaaccgcaaggagccagccgtctaaggtgggacagatgattggggtgaagtcgtaacaaggtagccgtaggagaacctgcggctggatcacctcctttct

SEQ ID NO: 1118 - DNA, 1558 bp, Lactobacillus saniviri
gatcatggctcaggatgaacgctggcggcgtgcctaatacatgcaagtcgaacgagttctggttaatgatggcggtgcttgcaccaatagatttaacatttgaacgagtggcggacgggtgagtaacacgtgggtaacctgccctaaagtgggggataacatttggaaacagatgctaataccgcataaatcttggaacctcatggttccaagctgaaagatggcgtaagctatcgcttttggatggacccgcggcgtattagctagttggtgaggtaaaggctcaccaaggcgatgatacgtagccgacctgagagggtgatcggccacattgggactgagacacggcccaaactcctacgggaggcagcagtagggaatcttccacaatggacgaaagtctgatggagcaacgccgcgtgagtgaagaaggttttcggatcgtaaaactctgttgttggagaagaacgtacgtgagagtaactgttcacgtagtgacggtatccaaccagaaagccacggctaactacgtgccagcagccgcggtaatacgtaggtggcaagcgttatccggatttattgggcgtaaagcgagcgcaggcggtttcttaagtctgatgtgaaagccctcggctcaaccgaggaagtgcatcggaaactgggaaacttgagtgcagaagaggacagtggaactccatgtgtagcggtggaatgcgtagatatatggaagaacaccagtggcgaaggcggctgtctggtctgtaactgacgctgaggctcgaaagcatgggtagcgaacaggattagataccctggtagtccatgccgtaaacgatgaatactaagtgttggagggtttccgcccttcagtgctgcagctaacgcattaagtattccgcctggggagtacgaccgcaaggttgaaactcaaaggaattgacgggggcccgcacaagcggtggagcatgtggtttaattcgaagcaacgcgaagaaccttaccaggtcttgacatcttctgctattctaagagattagaagttcccttcggggacagaatgacaggtggtgcatggttgtcgtcagctcgtgtcgtgagatgttgggttaagtcccgcaacgagcgcaacccttatgactagttgccagcattaagttgggcactctaatcagactgccggtgacaaaccggaggaaggtggggatgacgtcaaatcatcatgccccttatgacctgggctacacacgtgctacaatggatggtacaacgagtcgcaaaaccgcgaggttaagctaatctcttaaagccattctcagtccggactgtaggctgcaactcgcctacacgaagtcggaatcgctagtaatcgcggatcagcatgccgcggtgaatacgttcccgggccttgtacacaccgcccgtcacaccatgagagtttgtaacacccgaagccggtggggtaaccttttaggagctagccgtctaaggtgggacagatgattagggtgaagtcgtaacaaggtagccgtaggagaacctgcggctggatcacctccta

SEQ ID NO: 1119 - DNA, 1562 bp, Lactobacillus senioris
gagtttgatcatggctcaggacgaacgctggcggcgtgcctaatacatgcaagtcgaacgcgtcttggtgaatgatcggcggtgcttgcaccaaagagatttcacaatgagacgagtggcgaactggtgagtaacacgtggggaacctgcccataagcaggggataacacttggaaacaggtgctaataccgtataacaatgtaaaccgcatggtttacatttgaaagatggtttcggctatcacttatggatggacccgcggcgcattagctagttggtgaggtaacggctcaccaaggcaatgatgcgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttggagaagaacatggatgagagtaactgttcatttattgacggtatccaaccagaaagccacggctaactacgtgccagcagccgcggtaatacgtaggtggcaagcgttgtccggatttattgggcgtaaagcgagcgcaggcggtcttttaagtctgatgtgaaagccttcggcttaaccggagaagtgcatcggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgcaacgcgaagaaccttaccaggtcttgacatcttctgctaacccaagagattgggcgttcccttcggggacggaatgacaggtggtgcatggctgtcgtcagctcgtgtcgtgagatgttgggttaagtcccgcaacgagcgcaacccttattgttagttgccagcatttagttgggcactctagcaagactgccggtgacaaaccggaggaaggtggggatgacgtcaagtcctcatgccccttatgacctgggctacacacgtgctacaatggacggtacaacgagtcgcgaaaccgcgaggtcaagctaatctcttaaagccgttctcagttcggattgcaggctgcaactcgcctgcatgaagtcggaatcgctagtaatcgtggatcagcatgccacggtgaatacgttcccgggccttgtacacaccgcccgtcacaccatgagagtttgtaacacccaaagccggtggggtaaccttttaggagccagccgtctaaggtgggacagatgattagggtgaagtcgtaacaaggtagccgtaggagaacctgcggctcacctccta

SEQ ID NO: 1120 - DNA, 1617 bp, Lactobacillus sp.
  66c
gagttccactctcctcttctgcactcaagaatgacagtttccgatgcagttccacggttgagccgtgggctttcacatcagacttatcattccgcctgcgctcgctttacgcccaataaatccggacaacgcttgccacctacgtagagtttgatcatggctcaggacgaacgctgggcggcgtgcctaatacatgcaagtcgagcgagctgaattcacagatcccttcggagtgacgtgttggacgctagcggcggatgggtgagtaacacgtgggcaatctgccctaaagactgggataccacttggaaacaggtgctaataccggataacaatgatggttgcatgaccattatttgaaaggcggcgcaagctgtcactttaggatgagcccgcggtgcattagctagttggtgaggtaacggctcaccaaggccatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatgtgagtagcaactggctcatatttgacggtaatcaaccagaaagtcacggctaactacgtgccagcagccgcggtaatacgtaggtggcaagcgttgtccggatttattgggcgtaaagcgagcgcaggcggaatgataagtctgatgtgaaagcccacggctcaaccgtggaactgcatcggaaactgtcattcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagcgctaggtgttggggactttccggtcctcagtgccgcagcaaacgcattaagcgctccgcctggggagtacgaccgcaaggttgaaactcaaaggaattgacgggggcccgcacaagcggtggagcatgtggtttaattcgaagcaacgcgaagaaccttaccaggtcttgacatcctgagaccgttatagagatataattttcccttcggggactcagagacaggtggtgcatggctgtcgtcagctcgtgtcgtgagatgttgggttaagtcccgcaacgagcgcaacccttgtctttagttgccagcattaagttgggcactctagagagactgccggtgacaaaccggaggaaggtggggatgacgtcaagtcatcatgccccttatgacctgggctacacacgtgctacaatgggcagtacaacgagaagcgaacctgcgaaggcaagcggatctcttaaagctgttctcagttcggactgcaggctgcaactcgcctgcacgaagctggaatcgctagtaatcgcggatcagcacgccgcggtgaatacgttcccgggccttgtacacaccgcccgtcacaccatggaagtctgcaatgcccaaagtcggtgggataacccttttggaa

SEQ ID NO: 1121 - DNA, 1409 bp, Lactobacillus sp.
  BT6
  modified_base (8)..(8): a, c, t, g, unknown or other
  modified_base (14)..(14): a, c, t, g, unknown or other
  modified_base (40)..(40): a, c, t, g, unknown or other
tgattatntgaaanggtgcttgcatcttgatttaattttngaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatactaggtggcaagcgttatccggatttattgggcgtaaagcgagcgcaggcggttttttaagtctgatgtgaaagccctcggcttaaccgaggaagtgcatcggaaactggaaacttgagtgcagaagaggacagtggaactccatgtgtagcggtgaaatgcgtagatatatggaagaacaccagtggcgaaggcggctgtctggtctgtaactgacgctgagctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttaggg

SEQ ID NO: 1122 - DNA, 1238 bp, Lactobacillus sp.
  KLDS 1.0701
agcggcggatgggtgagtaacacgtggggaacctgccccatagtctgggataccacttggaaacaggtgctaataccggataagaaaagtcgctatgggatggccccgcggtgcattagctagttggtagggtaacggcctaccaaggcaatgatgcatagccgagttgagagactgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggtgaagatgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgactgacgctgaggctcgaaagcatgggtagcgaacaggattagataccctggtagtccatgccgtaaacgatgagtgctaagtgttgggatctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggctgtcgtcagctcgtgtcgtgagatgttgggttaagtcccgcaacgagcgcaacccttgtcattagttgccagcatgggcactctaatgagactgccggtgacaaaccggaggaaggtggggatgacgtcaagtcatcatgccccttatgacctgggctacacacgtgctacaatggacagcaacgaggagcaagcctgcgaaggcaagcgaatctcttctgttctcagttcggatgcagtctgcaactcgactgcagaagctggaatcgctagtaatcgcggatcagcacgccgcggtgaatacgttcccgggccttgtacacaccgcccgtcacaccatgggagtctgcaatgcccaaagccggtgcctaaggagccgtctaaggcagg

SEQ ID NO: 1123 - DNA, 1237 bp, Lactobacillus sp.
  KLDS 1.0702
agtggcgaactggtgagtaacacgtgggaaacctgcccagaagcgggggataacacctggaaacagatgctaataccgcataacgaaagtcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagatgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgactgacgctgaggctcgaaagtatgggtagcaaacaggattagataccctggtagtccataccgtaaacgatgaatgctaagtgttggagcttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatatacaggtggtgcatggttgtcgtcagctcgtgtcgtgagatgttgggttaagtcccgcaacgagcgcaacccttattatcagttgccagcatgggcactctggtgagactgccggtgacaaaccggaggaaggtggggatgacgtcaaatcatcatgccccttatgacctgggctacacacgtgctacaatggatggcaacgagttgcgaactcgcgagagtaagctaatctcttccattctcagttcggatgtaggctgcaactcgcctacagaagtcggaatcgctagtaatcgcggatcagcatgccgcggtgaatacgttcccgggccttgtacacaccgcccgtcacaccatgagagtttgtaacacccaaagtcggtgggtaaccagccgcctaaggtgg

SEQ ID NO: 1124 - DNA, 1236 bp, Lactobacillus sp.
  KLDS 1.0703
agtggcgaactggtgagtaacacgtgggaaacctgcccagaagcgggggataacacctggaaacagatgctaataccgcataacgaaagtcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagatgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgactgacgctgaggctcgaaagtatgggtagcaaacaggattagataccctggtagtccataccgtaaacgatgaatgctaagtgttggagcttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatatacaggtggtgcatggttgtcgtcagctcgtgtcgtgagatgttgggttaagtcccgcaacgagcgcaacccttattatcagttgccagcatgggcactctggtgagactgccggtgacaaaccggaggaaggtggggatgacgtcaaatcatcatgccccttatgacctgggctacacacgtgctacaatggatggcaacgagttgcgaactcgcgagagtaagctaatctcttccattctcagttcggatgtaggctgcaactcgcctacagaagtcggaatcgctagtaatcgcggatcagcatgccgcggtgaatacgttcccgggccttgtacacaccgcccgtcacaccatgagagtttgtaacacccaaagtcggtgggtaaccagccgcctaaggtg

SEQ ID NO: 1125 - DNA, 1264 bp, Lactobacillus sp.
  KLDS 1.0704
gcggcgtgctatacatgcagtcgaacgagtggcgaactggtgagtaacacgtgggaaacctgcccagaagcgggggataacacctggaaacagatgctaataccgcataacgaaagtcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagatgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgactgacgctgaggctcgaaagtatgggtagcaaacaggattagataccctggtagtccataccgtaaacgatgaatgctaagtgttggagcttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatatacaggtggtgcatggttgtcgtcagctcgtgtcgtgagatgttgggttaagtcccgcaacgagcgcaacccttattatcagttgccagcatgggcactctggtgagactgccggtgacaaaccggaggaaggtggggatgacgtcaaatcatcatgccccttatgacctgggctacacacgtgctacaatggatggcaacgagttgcgaactcgcgagagtaagctaatctcttccattctcagttcggatgtaggctgcaactcgcctacagaagtcggaatcgctagtaatcgcggatcagcatgccgcggtgaatacgttcccgggccttgtacacaccgcccgtcacaccatgagagtttgtaacacccaaagtcggtgggtaaccagccgcctaaggtgg

SEQ ID NO: 1126 - DNA, 1240 bp, Lactobacillus sp.
  KLDS 1.0705
agtggcgaactggtgagtaacacgtgggaaacctgcccagaagcgggggataacacctggaaacagatgctaataccgcataacgaaagtcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagatgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgactgacgctgaggctcgaaagtatgggtagcaaacaggattagataccctggtagtccataccgtaaacgatgaatgctaagtgttggagcttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatatacaggtggtgcatggttgtcgtcagctcgtgtcgtgagatgttgggttaagtcccgcaacgagcgcaacccttattatcagttgccagcatgggcactctggtgagactgccggtgacaaaccggaggaaggtggggatgacgtcaaatcatcatgccccttatgacctgggctacacacgtgctacaatggatggcaacgagttgcgaactcgcgagagtaagctaatctcttccattctcagttcggatgtaggctgcaactcgcctacagaagtcggaatcgctagtaatcgcggatcagcatgccgcggtgaatacgttcccgggccttgtacacaccgcccgtcacaccatgagagtttgtaacacccaaagtcggtgggtaaccagccgcctaaggtgggac

SEQ ID NO: 1127 - DNA, 1236 bp, Lactobacillus sp.
  KLDS 1.0707
agtggcggacgggtgagtaacacgtaggtaacctgcccagaagcgggggacaacatttggaaacagatgctaataccgcataacaaaagtcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagatgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgactgacgctgagactcgaaagcatgggtagcgaacaggattagataccctggtagtccatgccgtaaacgatgagtgctaggtgttggagcttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagcaaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgtaacacccaaagtcggtgggtagccagccgcctaaggtg

SEQ ID NO: 1128 - DNA, 1237 bp, Lactobacillus sp.
  KLDS 1.0709
agtggcggacgggtgagtaacacgtaggtaacctgcccagaagcgggggacaacatttggaaacagatgctaataccgcataacaaaagtcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagatgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgactgacgctgagactcgaaagcatgggtagcgaacaggattagataccctggtagtccatgccgtaaacgatgagtgctaggtgttggagcttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagcaaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgtaacacccaaagtcggtgggtagccagccgcctaaggtgg

SEQ ID NO: 1129 - DNA, 1236 bp, Lactobacillus sp.
  KLDS 1.0711
agtggcggacgggtgagtaacacgtaggtaacctgcccagaagcgggggacaacatttggaaacagatgctaataccgcataacaaaagtcacttctggatggacctgcggtgcattagcttgttggtggggtaatggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagatgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgactgacgctgagactcgaaagcatgggtagcgaacaggattagataccctggtagtccatgccgtaaacgatgagtgctaggtgttggagcttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagcaaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgtaacacccaaagtcggtgggtagccagccgcctaaggtg

SEQ ID NO: 1130 - DNA, 1238 bp, Lactobacillus sp.
  KLDS 1.0712
agcggcggatgggtgagtaacacgtggggaacctgccccatagtctgggataccacttggaaacaggtgctaataccggataagaaaagtcgctatgggatggccccgcggtgcattagctagttggtaaggtaaaggcttaccaaggcgatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagatgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgactgacgctgaggctcgaaagcatgggtagcgaacaggattagataccctggtagtccatgccgtaaacgatgagtgctaagtgttgggatctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggctgtcgtcagctcgtgtcgtgagatgttgggttaagtcccgcaacgagcgcaacccttgttattagttgccagcatgggcactctaatgagactgccggtgacaaaccggaggaaggtggggatgacgtcaagtcatcatgccccttatgacctgggctacacacgtgctacaatgggcagcaacgagaagcgagcctgcgaaggcaagcgaatctctgctgttctcagttcggatgcagtctgcaactcgactgcagaagctggaatcgctagtaatcgcggatcagcacgccgcggtgaatacgttcccgggccttgtacacaccgcccgtcacaccatgggagtctgcaatgcccaaagccggtgcctaaggagccgtctaaggcagg

SEQ ID NO: 1131 - DNA, 1237 bp, Lactobacillus sp.
  KLDS 1.0713
agtggcggacgggtgagtaacacgtaggtaacctgcccagaagcgggggacaacatttggaaacagatgctaataccgcataacaaaagtcacttctggatggacctgcggtgcattagcttgttggtggggtaatggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagatgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgactgacgctgagactcgaaagcatgggtagcgaacaggattagataccctggtagtccatgccgtaaacgatgagtgctaggtgttggagcttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagcaaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgtaacacccaaagtcggtgggtagccagccgcctaaggtgg

SEQ ID NO: 1132 - DNA, 1237 bp, Lactobacillus sp.
  KLDS 1.0716
agtggcggacgggtgagtaacacgtaggtaacctgccccaaagcgggggataacatttggaaacagatgctaataccgcataacaaaagtcactttgggatggacctgcggcgcattagcttgttggtagggtaacggcctaccaaggctgtgatgcgtagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttagagaagatgacggtatctaaccagaaagtcacggctaactacgtgccagcagccgcggtaatacgtaggtggcaagcgttatccggatttattgggcgtaaagcgagcgcaggcggtttgataagtctgatgtgaaagcctttggcttaaccaaagaagtgcatcggaaactgtcagacttgagtgcagaagaggacagtggaactccatgtgtagcggtggaatgcgtagatatatggaagaacaccagtggcgaaggcggctgtctggtctgactgacgctgaggctcgaaagcatgggtagcgaacaggattagataccctggtagtccatgccgtaaacgatgagtgctaggtgttggagcttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagctaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgcaacacccaaagtcggtgggtagctagccgcctaaggtgg

SEQ ID NO: 1133 - DNA, 1252 bp, Lactobacillus sp.
  KLDS 1.0718
atacatgcaagtcgaacgagtggcggacgggtgagtaacacgtaggtaacctgccccaaagcgggggataacatttggaaacagatgctaataccgcataacaaaagtcactttgggatggacctgcggcgcattagcttgttggtagggtaacggcctaccaaggctgtgatgcgtagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttagagaagatgacggtatctaaccagaaagtcacggctaactacgtgccagcagccgcggtaatacgtaggtggcaagcgttatccggatttattgggcgtaaagcgagcgcaggcggtttgataagtctgatgtgaaagcctttggcttaaccaaagaagtgcatcggaaactgtcagacttgagtgcagaagaggacagtggaactccatgtgtagcggtggaatgcgtagatatatggaagaacaccagtggcgaaggcggctgtctggtctgactgacgctgaggctcgaaagcatgggtagcgaacaggattagataccctggtagtccatgccgtaaacgatgagtgctaggtgttggagcttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagctaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgcaacacccaaagtcggtgggtagctagccgcctaagg

SEQ ID NO: 1134 - DNA, 1237 bp, Lactobacillus sp.
  KLDS 1.0719
agtggcggacgggtgagtaacacgtgggtaacctgcctaaaagaaggggataacacttggaaacaggtgctaataccgtatatcgaaagtcgcttttagatggacccgcggcgtattaactagttggtggggtaacggcctaccaaggtgatgatacgtagccgaactgagaggttgatcggccacattgggactgagacacggcccaaactcctacgggaggcagcagtagggaatcttccacaatggacgcaagtctgatggagcaacgccgcgtgagtgaagaaggtcttcggatcgtaaaactctgttgttagagaagatgacggtatctaaccagcaagtcacggctaactacgtgccagcagccgcggtaatacgtaggtggcaagcgttgtccggatttattgggcgtaaagggaacgcaggcggtcttttaagtctgatgtgaaagccttcggcttaaccggagtagtgcattggaaactggaagacttgagtgcagaagaggagagtggaactccatgtgtagcggtgaaatgcgtagatatatggaagaacaccagtggcgaaagcggctctctggtctgactgacgctgaggttcgaaagcgtgggtagcaaacaggattagataccctggtagtccacgccgtaaacgatgaatgctaggtgttggagcttcagtgccgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggctgtcgtcagctcgtgtcgtgagatgttgggttaagtcccgcaacgagcgcaacccttgttgtcagttgccagcatgggcactctggcgagactgccggtgacaaaccggaggaaggtggggacgacgtcaagtcatcatgccccttatgacctgggctacacacgtgctacaatggacggcaacgagtcgcaagaccgcgaggtttagctaatctcttccgttctcagttcggatgtaggctgcaactcgcctacagaagtcggaatcgctagtaatcgcgaatcagcatgtcgcggtgaatacgttcccgggccttgtacacaccgcccgtcacaccatgagagtttgtaacacccaaagccggtgggtagccagccgtctaaggtgg

SEQ ID NO: 1135 - DNA, 1364 bp, Lactobacillus sp.
  oral clone HT002
gagtttgattctggctcaggatgaacgccggcggtgtgcctaatacatgcaagtcgaacgagtggcggacgggtgagtaacacgtaggtaacctgcccggaagcgggggacaacatttggaaacagatgctaataccgcataacaaaagtcacttctggatggacctgcggtgcattagcttgttggtggggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagatgacggtatccaaccagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgactgacgctgaggctcgaaagcatgggtagcgaacaggattagataccctggtagtccatgccgtaaacgatgagtgctaagtgttgggatctcagtgctgcagctaacgcattaagcactccgcctggggagtacgaccgcaaggttgaaactcaaaggaattgacgggggcccgcacaagcggtggagcatgtggtttaattcgaagcgacgcgaagaaccttaccaggtcttgacatcgacaggtggtgcatggctgtcgtcagctcgtgtcgtgagatgttgggttaagtcccgcaacgagcgcaacccttgtcattagttgccatcatgggcactataatgagactgccggtgacaaaccggaggaaggtggggatgacgtcaagtcatcatgccccttatgacctgggctacacacgtgctacaatggacggcaacgagaagcgaacctgcgaaggcaagcggatctctgccgttctcagttcggatgtaggctgcaactcgcctacagaagctggaatcgctagtaatcgcggatcagcacgccgcggtgaatacgttcccgggccttgtacacaccgcccgtcacaccatgagagtctgtaacacccaaagccggtggatagtcagccgtctaaggtaggacagatgattagggtgaagtcgtaacaaggtagccgtaggagaacctgcggctggatcacctcctt

SEQ ID NO: 1136 - DNA, 1361 bp, Lactobacillus sp.
  oral clone HT070
gagtttgattctggctcaggacgaacgctggcggcgtgcctaatacatgcaagtcgagcgagcggcggatgggtgagtaacacgtggggaacctgccccagagtctgggataccacttggaaacaggtgctaataccggataagaaaagtcgctcagggatggccccgcggtgcattagctagttggcaaggtaacggcctaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagatgacggtaatcaaccagaaagtcacggctaactacgtgccagcagccgcggtaatacgtaggtggcaagcgttgtccggatttattgggcgtaaagcgagcgcaggcggaaaaataagtctaatgtgaaagccctcggcttaaccgaggaattgcatcggaaactgtttttcttgagtgcagaagaggagagtggaactccatgtgtagcggtggaatgcgtagatatatggaagaacaccagtggcgaaggcggctctctggtctgactgacgctgaggctcgaaagcatgggtagcgaacaggattagataccctggtagtccatgccgtaaacgatgagtgctaagtgttgggatctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggctgtcgtcagctcgtgtcgtgagatgttgggttaagtcccgcaacgagcgcaacccttgttattagttgccagcatgggcactctaatgagactgccggtgacaaaccggaggaaggtggggatgacgtcaagtcatcatgccccttatgacctgggctacacacgtgctacaatggacagcaacgagcagcgagcctgcgaaggcaagcgaatctctgctgttctcagttcggatgcagtctgcaactcgactgcagaagctggaatcgctagtaatcgcggatcagcacgccgcggtgaatacgttcccgggccttgtacacaccgcccgtcacaccatgggagtctgcaatgcccaaagccggtgcctaaggagccgtctaaggcagggcagatgactggggtgaagtcgtacaaggtagccgtaggaaacctgcggctggacacctcctt

SEQ ID NO: 1137 - DNA, 994 bp, Lactobacillus sp.
  oral taxon 052
  modified_base (43)..(43): a, c, t, g, unknown or other
  modified_base (45)..(45): a, c, t, g, unknown or other
  modified_base (633)..(633): a, c, t, g, unknown or other
  modified_base (635)..(635): a, c, t, g, unknown or other
  modified_base (637)..(637): a, c, t, g, unknown or other
  modified_base (727)..(727): a, c, t, g, unknown or other
  modified_base (876)..(876): a, c, t, g, unknown or other
  modified_base (944)..(945): a, c, t, g, unknown or other
  modified_base (978)..(978): a, c, t, g, unknown or other
  modified_base (984)..(986): a, c, t, g, unknown or other
cgcactggcccaactgagatgacgtgcttgcactgatttgacnanggattaccagtgagtggcggacgggtgagtaacacgtaggcaacctgcccaagagcgggggataacatttggaaacaagtgctaataccgcataagattgatgaccacatggtcatcaatttaaagatggcttcggctatcactcttggatgggcctgcggtgcattagctagttggtaaggtaacggcttaccaaggcagtgatgcatagccgagttgagagactgatcggccacaatgggactgagacacggcccatactcctacgggaggcagcagtagggaatcttccacaatgggcgcaagcctgatggagcgacaccgcgtgagtgaagaagggtttcggctcgtaaagctctgttgttgaagaagaacgtgcgtgagagtaactgttcacgcagtgacggtattcaaccagaaagtcacggctaactacgtgccagcagccgcggtaatacgtaggtggcaagcgttatccggatttattgggcgtaaagcgagcgcaggcggttttctaagtctgatgtgaaagccttcggcttaaccgaagaagggcatcggaaactggatgacttgagtgcagaagangncngtggaactccatgtgtagcggtggaatgcgtagatatatggaagaacaccagtggcgaaggcggctgcctagtctgcaactgacgctgangctcgaaagcatgggtagcgaacaggattagataccctggtagtccatgccgtaaacgatgagtgctaggtgttggagggtttccgcccttcagtgccgcagctaacgcaataagcactccgcctggggagtacgaccgcaaggttganctcaaaggaattgacgggggcccgcacaagcggtggagcatgtggtttaattcgaagctacgcgagannttaccaggtcttgacatcttgcgctaacctaanagattnnngttccctt

SEQ ID NO: 1138 - DNA, 1557 bp, Lactobacillus tucceti
  modified_base (1548)..(1548): a, c, t, g, unknown or other
ttaagagtttgatttaggctcaggacgaacgctggcggcgtgcctaatacatgcaagtcgagcgaactctggtaactgaacgatgggtgcttgcaccggagtgatgatacatttgagtgagcggcggatgggtgagtaacacgtgggtaacctgccctaaagtgggggataacatctggaaacaggtgctaataccgcataacaacatttaccacatggtttatgtttgaaagatggttctgctatcgctttaggatggacccgcggcgtattagctagttggtgaggtaacggctcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagtaactgttcatgtattgacggtattcaaccagaaagccacggctaactacgtgccagcagccgcggtaatacgtaggtggcaagcgttgtccggatttattgggcgtaaagcgagcgtaggcggtttattaagtctgatgtgaaagccctcggctcaaccgaggaagtgcatcggaaactggtaaacttgagtgcagaagaggaaagtggaactccatgtgtagcggtggaatgcgtagatatatggaagaacaccagtggcgaaggcggctttctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatcttgaaagtctaagagattagaggttcccttcggggacaagaatacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgcaggctgcaactcgcctgcatgaagctggaatcgctagtaatcgtggatcagcatgccacggtgaatacgttcccgggccttgtacacaccgcccgtcacaccatgagagtttgtaacacccaaagccggtggggtaaccttttaggagctagccgtctaaggtgggacaaatgattagggtgaagtcgtaacaaggtagccgtaggagancctgcggct

SEQ ID NO: 1139 - DNA, 1561 bp, Lactobacillus ultunensis
tgagagtttgatcctggctcaggacgaacgctggcggcgtgcctaatacatgcaagtcgagcgagcggaaccagcagatctgcttcggcagtgacgctgggaaagcgagcggcggatgggtgagtaacacgtggggaacctgccccaaagtctgggataccacttggaaacaggtgctaataccggataagaaagcagatcgcatgatcagcttttaaaaggcggcgtaagctgtcgctatgggatggccccgcggtgcattagctagttggtagagtaacggcctaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaaaaataagtctaatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccatcttcagagatgaagagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagtacaacgagaagcgagcctgcgaaggcaagcgaatctctgaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaacgcccaaagccggtggcctaaccgaaaggaaggagccgtctaaggcagggcagatgactggggtgaagtcgtaacaaggtagccgtaggagaacctgcggctggatcacctcctttct

SEQ ID NO: 1140 - DNA, 1410 bp, Lactobacillus vaginalis
gggggataacatctggaaacaggtgctaataccgcataacaacgaaaaccacatggttttcgtttcaaagatggtttcggctatcacttcaggatgggcccgcggtgcattagctagttggtaaggtaacggcttaccaaggcaatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagggcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaacctaagagattaggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagttgcgaactcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatggaagtttgcaatgcccaaagtcggtggcctaaccatttggagggaaccgcctaaggcagggcagatgactggggtgaagtcgtaacaaggtagccgtaggagaacctgcggctggatcacctcctttct

SEQ ID NO: 1141 - DNA, 1503 bp, Lactobacillus vini
agagtttgattatggctcaggacgaacgctggcggcgtgcctaatacatgcaagtcgaacgagactttttatttgatgcttgcatcttttaaaaagttgagtggcgaacgggtgagtaacacgtgggtaacctgccttaaagtgggggataacacttggaaacaggtgctaataccgcataaccatcaaaaccgcctggttttgatgttaaagatggttctgctatcgctttaagatggacccgcggcgtattagctagttggtgaggtaacggcttaccaaggcaatgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgtcagagaagaacgtgtgtgagagtaactgttcacgcagtgacggtatctgaccagaaagtcacggctaactacgtgccagcagccgcggtaatacgtaggtggcaagcgttgtccggatttattgggcgtaaagggaacgcaggcggtcttttaagtctgatgtgaaagccttcggcttaaccgaagtcgggcattggaaactgggagacttgagtgcagaagaagagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaagtgttggagggtttccgcccttcagtgccgcagctaacgcattaagcattccgcctggggagtacgatcgcaagattgaaactcaaaggaattgacgggggcccgcacaagcggtggagcatgtggtttaattcgaagcaacgcgaagaaccttaccaggtcttgacatcttttgctaacctgagagatcaggtgttcccttcggggacaaaatgacaggtggtgcatggttgtcgtcagctcgtgtcgtgagatgttgggttaagtcccgcaacgagcgcaacccttattgttagttgccagcatttagttgggcactctaacgagactgccggtgacaaaccggaggaaggtggggatgacgtcaaatcatcatgccccttatgacctgggctacacacgtgctacaatggacggtacaacgagtcgcaagaccgcgaggtcaagctaatctctgaaaaccgttctcagttcggattgcaggctgcaactcgcctgcatgaagtcggaatcgctagtaatcgcggatcagcatgccgcggtgaatacgttcccgggccttgtacacaccgcccgtcacaccatgagagtttgtaacacccaaagccggtggggtaacctttgggagccagccgtctaaggtgggacagatgattggggtgaaga

SEQ ID NO: 1142 - DNA, 1450 bp, Lactobacillus vitulinus
gatgaacgctggcggcgtgcctaatacatgcaagtcgaacgggaatcttcggattccagtggcgaacgggtgaggaatacataggtaacctgcccctccgagggggacaacagacggaaacatctgctaagaccgcatagccacagggaaggcatcttccctgtgccaaatgtcctttcggggacagcggggggatggacctatgccgcattagctggttggcggggcaacggcccaccaaggcgacgatgcgtagccggcctgagagggcggacggccacactgggactgagacacggcccagactcctacgggaggcagcagtagggaattttcggcaatgggggaaaccctgaccgagcaacgccgcgtgaacgatgaaggccttcgggtcgtaaagttctgttgcgaaggaagaacgccggtgtcaggaaatgggcgccgggtgacggtacttcgcatagaaagccacggctaactacgtgccagcagccgcggtaatacgtaggtggcgagcgttatccggaatcattgggcgtaaagagggagcaggcggcgatacaggtctgtggtgaaattccgaagctaaacttcggccagccaaagaaaccggatcgctagagtgcggaagaggatcgtggaattccatgtgtagcggtgaaatgcgtagatatatggaggaacaccagtggcgaaggcgacggtctgggccgcaactgacgctcattcccgaaagcgtggggagcaaataggattagataccctagtagtccacgccgtaaacgatcgatactaagtgtcgggggtcaaacctcggtgctggagtcaacgcaataagtatcgcgcctgagtagtacgttcgcaagaatgaaactcaaaggaattgacgggggcccgcacaagcggtggagcatgtggtttaattcgaagcaacgcgaagaaccttaccaggtcttgacatcgatccaaaagggacggaaacgtccccatagctatggagaagacaggtggtgcatggtgtcgtcagctcgtgtcgtgagatgttgggttaagtcccgcaacgagcgcaacccctgtcgccagttgccagcattgagttggggactctggcgagactgcctctgcaaggaggaggaaggcggggatgacgtcaaatcatcatgccccttatgacctgggccacacacgtgctacaatggacggagcagagggaagcgaagcggcgacgccaagcggatcccagaaacccgttctcagttcggactgcagtctgcaactcgactgcacgaagctggaatcgctagtaatcgcggatcagcatgccgcggtgaatacgttctcgggccttgtacacaccgcccgtcacaccatgagagtcggcaacacccgaagccggtggctcaacccttctgggagggagctgtctaaggtggggccgatgattggggtg

SEQ ID NO: 1143 - DNA, 1419 bp, Lactobacillus zeae
cgagttttggtcgatgaacggtgcttgcatcgtgattcaacttaaaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgagctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacgtcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcattcagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagc

SEQ ID NO: 1144 - DNA, 1485 bp, Lactococcus garvieae
aacgctggcggcgtgcctaatacatgcaagtcgagcgatgattaaagatagcttgctatttttatgaagagcggcgaacgggtgagtaacgcgtgggaaatctgccgagtagcgggggacaacgtttggaaacgaacgctaataccgcataacaatgagaatcgcatgattcttatttaaaagaagcaattgcttcactacttgatgatcccgcgttgtattagctagttggtagtgtaaaggactaccaaggcgatgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaaactctgttgttagagaagaacgttaagtagagtggaaaattacttaagtgacggtatctaaccagaaagggacggctaactacgtgccagcagccgcggtaatacgtaggtcccaagcgttgtccggatttattgggcgtaaagcgagcgcaggtggtttcttaagtctgatgtaaaaggcagtggctcaaccattgtgtgcattggaaactgggagacttgagtgcaggagaggagagtggaattccatgtgtagcggtgaaatgcgtagatatatggaggaacaccggaggcgaaagcggctctctggcctgtaactgacactgaggctcgaaagcgtggggagcaaacaggattagataccctggtagtccacgccgtaaacgatgagtgctagctgtagggagctataagttctctgtagcgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctatccttagagataaggagttccttcgggacacgggatacaggtggtgcatggttgtcgtcagctcgtgtcgtgagatgttgggttaagtcccgcaacgagcgcaacccttattactagttgccatcattaagttgggcactctagtgagactgccggtgataaaccggaggaaggtggggatgacgtcaaatcatcatgccccttatgacctgggctacacacgtgctacaatggatggtacaacgagtcgccaacccgcgagggtgcgctaatctcttaaaaccattctcagttcggattgcaggctgcaactcgcctgcatgaagtcggaatcgctagtaatcgcggatcagcacgccgcggtgaatacgttcccgggccttgtacacaccgcccgtcacaccacggaagttgggagtacccaaagtaggttgcctaaccgcaaggagggcgcttcctaaggtaagaccgatgactggggtgaagtcgtaacaaggtagc

SEQ ID NO: 1145 - DNA, 1554 bp, Lactococcus lactis
ctttatttgagagtttgatcctggctcaggacgaacgctggcggcgtgcctaatacatgcaagttgagcgctgaaggttggtacttgtaccgactggatgagcagcgaacgggtgagtaacgcgtggggaatctgcctttgagcgggggacaacatttggaaacgaatgctaataccgcataaaaactttaaacacaagttttaagtttgaaagatgcaattgcatcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttggtagagaagaacgttggtgagagtggaaagctcatcaagtgacggtaactacccagaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacaggattagataccctggtagtccacgccgtaaacgatgagtgctagatgtagggagctataagttctctgtatcgcagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctattcctagagataggaagttccttcgggacacgggatacaggtggtgcatggttgtcgtcagctcgtgtcgtgagatgttgggttaagtcccgcaacgagcgcaacccctattgttagttgccatcattaagttgggcactctaacgagactgccggtgataaaccggaggaaggtggggatgacgtcaaatcatcatgccccttatgacctgggctacacacgtgctacaatggatggtacaacgagtcgcgagacagtgatgtttagctaatctcttaaaaccattctcagttcggattgtaggctgcaactcgcctacatgaagtcggaatcgctagtaatcgcggatcagcacgccgcggtgaatacgttcccgggccttgtacacaccgcccgtcacaccacgggagttgggagtacccgaagtaggttgcctaaccgcaaggagggcgcttcctaaggtaagaccgatgactggggtgaagtcgtaacaaggtagccgtatcggaaggtgcggctggatcacctcctttctaag

SEQ ID NO: 1146 - DNA, 1440 bp, Lactococcus raffinolactis
agttgaacgcttgattttcaccgaagcttgcttcaccgaaaatcaagagtagcgaacgggtgagtaacgcgtgggtaacctacctatcagcgggggataactattggaaacgatagctaataccgcataacaatgttggatgcatattcgacatttgaaagtaccaaatggtacactgagagatggacccgcgttgtattagctagttggtagtgtaatggactaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacgttgcatagagtggaaaattatgcaagtgacggtatctaaccagaaagggacggctaactacgtgccagcagccgcggtaatacgtaggtcccgagcgttgtccggatttattgggcgtaaagcgagcgcaggtggtttaataagtctgatgtaaaaggcagtggctcaaccattgtgtgcattggaaactgttagacttgagtgcagtagaggagagtggaattccatgtgtagcggtgaaatgcgtagatatatggaggaacaccggtggcgaaagcggctctctggactgtcactgacactgaggctcgaaagcgtgggtagcaaacaggattagataccctggtagtccacgccgtaaacgatgagtgctagttgtttggggctatccagccctaagtgacgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctattcctagagataggaagttccttcgggacacgggatacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaaggcagtgatgtcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaatacccaaagccggtgagctaaccttttaggaggcagccgtctaaggtaggatagatgat

SEQ ID NO: 1147 - DNA, 1281 bp, Lactonifactor longoviformis
gagtttgattatggctcaggatgaacgctggcggcgtgcttaacacatgcaagtcgaacgagtggcggacgggtgagtaacgcgtggataacctgcctcatacagggggataacagttagaaatgactgctaataccgcataagaaaaggcggtatgagatggatccgcgtttgattagctagttggtggggtaaaggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagatgacggtacctgactaagaagccccggctaattacgtgccagcagccgcggtaatacgtaaggggcaagcgttatccggatttactgggtgtaaagggagcgtagacggcagtgcaagtctgatgtgaaagcccggggctcaaccccgggactgcattggaaactgtgcagctagagtgtcggagaggtaagtggaattcctagtgtagcggtgaaatgcgtagatattaggaggaacaccagtggcgaaggcggcttactggacgaactgacgttgaggctcgaaagcgtggggagcaaacaggattagataccctggtagtccacgccgtaaacgatgaatactaggtgtcgggcgttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccttatccttagtagccagcagctgggcactctagggagactgccagggacaacctggaggaaggtggggatgacgtcaaatcatcatgccccttatgatttgggctacacacgtgctacaatggcgtacaaagggaagcgaaggggtgacctgaagcaaatcccaaaacgtctcagttcggatgtagtctgcaactcgactacagaagctggaatcgctagtaatcgcgaatcagaatgtcgcggtgaatacgttcccgggtcttgtacacaccgcccgtcacaccatgggagtcggatatgcccgaagccggtaccga

SEQ ID NO: 1148 - DNA, 1544 bp, Laribacter hongkongensis
tgaacgaaagagtttgatcctggctcagattgaacgctggcggcatgctttacacatgcaagtcgaacggtaacagggacttcggtctgctgacgagtggcgaacgggtgagtaatgcatcggaacgtaccgagtaatgggggataacgcatcgaaaggtgtgctaataccgcatacgccctgagggggaaagcgggggatcgaaagacctcgcgttattcgagcggccgatgccggattagctagttggtggggtaaaggctcaccaaggcgacgatccgtagcaggtctgagaggatgatctgccacactgggactgagacacggcccagactcctacgggaggcagcagtggggaattttggacaatgggggcaaccctgatccagccatgccgcgtgtctgaagaaggccttcgggttgtaaaggacttttgtcagggaggaaatccttaaggctaatacccttgggggatgacagtacctgaagaataagcaccggctaactacgtgccagcagccgcggtaatacgtagggtgcaagcgttaatcggaattactgggcgtaaagcgtgcgcaggcggtttgaaaagtcagctgtgaaagccccgggctcaacctgggaactgcggttgaaactctcaagctagagtgcgtcagaggggggtggaattccacgtgtagcagtgaaatgcgtagagatgtggaggaacaccaatggcgaaggcagccccctgggatgacactgacgctcatgcacgaaagcgtggggagcaaacaggattagataacctggtagtccacgccctaaacgatgtcgactagccgttggagatttcggtttctggtggcgcagctaacgcgtgaagtcgaccgcctggggagtacggtcgcaagattaaaactcaaaggaattgacgggggcccgcacaagcggtggatgatgtggattaattcgatgcaacgcgaaaaaccttacctggtcttgacatgtaccgaacctcgaagagatttgagggtgcccgaaagggagcggtaacacaggtgctgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcctcatggcccttatgaccagggcttcacacgtcatacaatggtcggtacagagggtcgctaagccgcgaggtagtgccaatctcataaaaccgatcgtagtccggatcgcagtctgcaactcgactgcgtgaagtcggaatcgctagtaatcgcggatcagcatgtcgcggtgaatacgttcccgggccttgtacacaccgcccgtcacaccatgggagtggaatccgccagaagtgggtagggtaaccgtaaggagcccgcttaccacggtaggtttcatgactggggtgaagtcgtaacaaggtagccgtaggggaacctgcggctggatcacctcctttctagaga

SEQ ID NO: 1149 - DNA, 1534 bp, Lautropia mirabilis
ttgaactgaagagtttgatcctggctcagattgaacgctggcggcatgctttacacatgcaagtcgaacggcagcgcgggcttcggcctggcggcgagtggcgaacgggtgagtaatacatcggaacgtgcccagtagtgggggatagctcggcgaaagccggattaataccgcatacgacctgagggtgaaagcgggggatcttcggacctcgcgctattggagcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatccagcaatgccgcgtgtgtgatgaaggccttcgggttgtaaagcacttttggcgggaacgaaaaggactgtgccaataccacggttcgatgacggtacccgcagaataagcaccggctaactacgtgccagcagccgcggtaatacgtagggtgcaagcgttaatcggaattactgggcgtaaagagtgcgcaggcggttttgcaagaccgatgtgaaatccccgggcttaacctgggaactgcattggtgactgcaaggctagagtgtgtcagagggaggtggaattccgcatgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtctactagttgtcggggattaatttccttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacgcttgacatgtccggaaccctgaagagatttgggggtgctcgaaagagagccggaacacaggtgctgcatggctgtcgtcagctcgtgtcgtgagatgttgggttaagtcccgcaacgagcgcaacccttatcattagttgctacgcaagggcactctaatgagactgccggtgacaaaccggaggaaggtggggatgacgtcaagtcctcatggcccttatgtgtagggcttcacacgtcatacaatggtcggtacagagggttgcgaagccgcgaggtggagccaatcccaaaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtgggttttaccagaagtaggtagcttaaccgcaaggagggcgcttaccacggtagggctcatgactggggtgaagtcgtaacaaggtagccgtaccggaaggtgcggctggatcacctcctttc

SEQ ID NO: 1150 - DNA, 1491 bp, Lautropia sp.
  oral clone AP009
agagtttgattatggctcagattgaacgctggcggcatgctttacacatgcaagtcgaacggcagcgcgggcttcggcctggcggcgagtggcgaacgggtgagtaatacatcggaacgtgcccagtagtgggggatagctcggcgaaagccggattaataccgcatacgacctgagggtgaaagcgggggatcttcggacctcgcgctattggagcggccgatggcagattagctggttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgatgaaggccttcgggttgtaaagcacttttggcgggaacgaaaaggactgtgccaataccacggttcgatgacggtacccgcagaataagcaccggctaactacgtgccagcagccgcggtaatacgtagggtgcgagcgttaatcggaattactgggcgtaaagagtgcgcaggcggttttgcaagaccgatgtgaaatccccgggcttaacctgggaactgcattggtgactgcaaggctagagtgtgtcagagggaggtggaactccgcatgtagcagtgaaatgcgtagatatgcggaagaacaccgatggcgaaggcagcctcctgggataacactgacgctcatgcacgaaagcgtggggagcaaacaggattagataccctggtagtccacgccctaaacgatgtctactagttgtcggggattaatttccttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacgcttgacatgtccggaaccttggagagattcgagggtgcccgaaagggaaccggaacacaggtgctgcatggctgtcgtcagctcgtgtcgtgagatgttgggttaagtcccgcaacgagcgcaacccttatcattagttgctacgcaagggcactctaatgagactgccggtgacaaacckgagkaaggtggggatgacgtcaagtcctcatggcccttatgtgtagggcttcacacgtcatacaatggtcggtacagagggttgccaagccgcgaggtggagccaatcccacaaaaccgatcgtagtccggattgcagtctgcaactcgactgcatgaagtcggaatcgctagtaatcgcggwtcagcatgccgcggtgaatacgttcccgggtcttgtacacaccgcccgtcacaccatgggagtgggttttaccagaagtaggtagcttaaccgcaaggggggcgcttaccacggtagggctcatgactggggtgaagtcgtaacaaggtaac

SEQ ID NO: 1151 - DNA, 1467 bp, Legionella hackeliae
  modified_base (8)..(8): a, c, t, g, unknown or other
  modified_base (23)..(24): a, c, t, g, unknown or other
  modified_base (31)..(31): a, c, t, g, unknown or other
  modified_base (42)..(42): a, c, t, g, unknown or other
  modified_base (70)..(71): a, c, t, g, unknown or other
  modified_base (74)..(74): a, c, t, g, unknown or other
  modified_base (82)..(82): a, c, t, g, unknown or other
  modified_base (112)..(112): a, c, t, g, unknown or other
  modified_base (149)..(149): a, c, t, g, unknown or other
  modified_base (158)..(158): a, c, t, g, unknown or other
  modified_base (164)..(164): a, c, t, g, unknown or other
  modified_base (174)..(174): a, c, t, g, unknown or other
  modified_base (210)..(210): a, c, t, g, unknown or other
  modified_base (216)..(216): a, c, t, g, unknown or other
  modified_base (243)..(243): a, c, t, g, unknown or other
  modified_base (359)..(359): a, c, t, g, unknown or other
  modified_base (414)..(414): a, c, t, g, unknown or other
  modified_base (420)..(420): a, c, t, g, unknown or other
  modified_base (447)..(447): a, c, t, g, unknown or other
  modified_base (466)..(466): a, c, t, g, unknown or other
  modified_base (471)..(471): a, c, t, g, unknown or other
  modified_base (502)..(502): a, c, t, g, unknown or other
  modified_base (525)..(525): a, c, t, g, unknown or other
  modified_base (546)..(546): a, c, t, g, unknown or other
  modified_base (565)..(565): a, c, t, g, unknown or other
  modified_base (583)..(584): a, c, t, g, unknown or other
  modified_base (592)..(592): a, c, t, g, unknown or other
  modified_base (596)..(596): a, c, t, g, unknown or other
  modified_base (613)..(613): a, c, t, g, unknown or other
  modified_base (625)..(625): a, c, t, g, unknown or other
  modified_base (629)..(629): a, c, t, g, unknown or other
  modified_base (632)..(632): a, c, t, g, unknown or other
  modified_base (646)..(646): a, c, t, g, unknown or other
  modified_base (686)..(686): a, c, t, g, unknown or other
  modified_base (734)..(734): a, c, t, g, unknown or other
  modified_base (739)..(739): a, c, t, g, unknown or other
  modified_base (833)..(833): a, c, t, g, unknown or other
  modified_base (879)..(879): a, c, t, g, unknown or other
  modified_base (938)..(938): a, c, t, g, unknown or other
  modified_base (950)..(952): a, c, t, g, unknown or other
  modified_base (961)..(961): a, c, t, g, unknown or other
  modified_base (976)..(976): a, c, t, g, unknown or other
  modified_base (986)..(986): a, c, t, g, unknown or other
  modified_base (1085)..(1085): a, c, t, g, unknown or other
  modified_base (1110)..(1110): a, c, t, g, unknown or other
  modified_base (1205)..(1205): a, c, t, g, unknown or other
  modified_base (1268)..(1268): a, c, t, g, unknown or other
  modified_base (1280)..(1280): a, c, t, g, unknown or other
  modified_base (1288)..(1288): a, c, t, g, unknown or other
  modified_base (1294)..(1294): a, c, t, g, unknown or other
  modified_base (1344)..(1344): a, c, t, g, unknown or other
agagtttnatcctggctcagatnnaacgctngcggcatgctnaacacatgcaagtcgaacggcagcatgnnctngctggctnggaagatggcgagtggcgaacgggtgagtnacgcgtaggaatrtgccttaaagagggggacaacctngggaaactnaggctnataccgcatnatttctgaggaaaaaagctggggaccgcaaggcctngcgctnaaagattagcctgcgtccgattagctngttggtggggtaagggcctaccaaggcgacgatcggtagctggtctgagaggatgatcagccacactgggactgagacacggcccagactcctacgggaggcagcagtggggaatnttggacaatggggggaaccctratccagcaatgccgcgtgtgtgaagaaggcctnagggtngtaaagcactttcagtggggaggaganraggttaggttaagagctngactnaaggacgcacccacagaagaagcaccggctnactccgtgccagcagccgcggtnatacggagggtgcaagcgttnatcggaattactgggcgtnaagggtgcgtaggtggtnnaataagtnagtngtgaaatccctrggctnaacctgggaatngcanctnagactgttagactngagtataggagagggtagtggaatttccggtgtagcggtnaaatgcgtagagatcggaaggaacaccagtggcgaaggcggctacctngcctnatactgacactgaggcacgaaagcgtggggagcaaacaggattagataccctggtagtccacgctgtaaacgatgtcaactagctrttggtctnataaatgagattagtggcgcagcaaacgcgataagttgaccgcctngggagtacggtcgcaagatyaaaactcaaaggaattgacgggggcccgcacaagcggtngagcatgtggtnnnattcgatgnaacgcgaagaacctnacctaccctngacatacagtgaatgatgcagagatgcatyagtgccttcgggaacactgatacaggtgctgcatggctgtcgtcagctcgtgtcgtgagatgttgggtnaagtcccgtaacgagcgcaaccctngtccttagttgccagcgcgtagaggcgggaactctagggagactgccggtgacaaaccggaggaaggcggggatgacgtcaagtcatcatrgccnttacgggtagggctacacacgtgctacaatggccggtacagagggaagcgaaggggcgacctngagcaaatcctnaaaagctngtcgtngtccggattggagtctgcaactcgactccatgaagtcggaatcgctagtnatcgcgaatcagcatgtcgcggtgaatacgttcccgggccttgtacacaccgcccgtcacaccatgggagtgggttgcaccagaagtagatagtctaaccttcggggggacgtrtaccacggt

SEQ ID NO: 1152 - DNA, 1473 bp, Legionella longbeachae
  modified_base (13)..(14): a, c, t, g, unknown or other
  modified_base (29)..(30): a, c, t, g, unknown or other
  modified_base (37)..(37): a, c, t, g, unknown or other
  modified_base (48)..(48): a, c, t, g, unknown or other
  modified_base (84)..(84): a, c, t, g, unknown or other
  modified_base (88)..(88): a, c, t, g, unknown or other
  modified_base (92)..(92): a, c, t, g, unknown or other
  modified_base (137)..(137): a, c, t, g, unknown or other
  modified_base (164)..(164): a, c, t, g, unknown or other
  modified_base (170)..(170): a, c, t, g, unknown or other
  modified_base (177)..(177): a, c, t, g, unknown or other
  modified_base (216)..(216): a, c, t, g, unknown or other
  modified_base (222)..(222): a, c, t, g, unknown or other
  modified_base (236)..(236): a, c, t, g, unknown or other
  modified_base (249)..(249): a, c, t, g, unknown or other
  modified_base (365)..(365): a, c, t, g, unknown or other
  modified_base (420)..(420): a, c, t, g, unknown or other
  modified_base (464)..(464): a, c, t, g, unknown or other
  modified_base (471)..(471): a, c, t, g, unknown or other
  modified_base (478)..(479): a, c, t, g, unknown or other
  modified_base (508)..(508): a, c, t, g, unknown or other
  modified_base (552)..(552): a, c, t, g, unknown or other
  modified_base (571)..(571): a, c, t, g, unknown or other
  modified_base (590)..(590): a, c, t, g, unknown or other
  modified_base (598)..(598): a, c, t, g, unknown or other
  modified_base (619)..(619): a, c, t, g, unknown or other
  modified_base (740)..(740): a, c, t, g, unknown or other
  modified_base (745)..(745): a, c, t, g, unknown or other
  modified_base (765)..(765): a, c, t, g, unknown or other
  modified_base (846)..(846): a, c, t, g, unknown or other
  modified_base (885)..(885): a, c, t, g, unknown or other
  modified_base (906)..(906): a, c, t, g, unknown or other
  modified_base (944)..(944): a, c, t, g, unknown or other
  modified_base (956)..(958): a, c, t, g, unknown or other
  modified_base (982)..(982): a, c, t, g, unknown or other
  modified_base (992)..(992): a, c, t, g, unknown or other
  modified_base (1091)..(1091): a, c, t, g, unknown or other
  modified_base (1116)..(1116): a, c, t, g, unknown or other
  modified_base (1211)..(1211): a, c, t, g, unknown or other
  modified_base (1274)..(1274): a, c, t, g, unknown or other
  modified_base (1300)..(1300): a, c, t, g, unknown or other
  modified_base (1374)..(1374): a, c, t, g, unknown or other
aactgaagagttnnatcctggctcagatnnaacgctngcggcatgctnaacacatgcaagtcgaacggcagcatgacctagctngctnggtngatggcgagtgccgaacgggtgagtaacgcgtaggaatrtgcctnaaagactgggataacttggggaaactnaagctnataccgnatgatgtctgaggacgaaagctggggaccttcgggcctngcgctnaaagattagcctgngtccgatyagctngttggtggggtaagggcctaccaaggcgacgatcggtagctggtctgagaggatgaccagccacactggaactgagacacggtccaggctcctacgggaggcagcagtggggaatnttggacaatgggggcaaccctratccagcaatgccgcgtgtgtgaagaaggcctnagggtygtaaagcactttcagtggggaggagggtygataggtgnagagctnatggatnngacgttacccacagaagaagcaccggctnactccgtgccagcagccgcggtaatacggagggtgctagcgttnatcggaattactgggcgtnaagcgtgcgtaggtggttnattaagtnatctgtgaaatccctrggctnaacctgggcaggtcagatgatactggttgactcgagtatgggagagggtagtggaatttccggtgtagcggtgaaatgcgtagagatcggaaggaacaccagtggcgaaggcggctacctngcctnatactgacactgaggcacgnaagcgtggggagcaaacaggattagataccctggtagtccacgccgtaaacgatgtcaactagctrttggatatatgaatntrtttagtggcgcagcaaacgcgataagtwgaccgcctngggagtacggtcgcaagayynaaactcaaaggaattgacgggggcccgcacaagcggtngagcatgtggtnnnattcgatgcaacgcgaagaacctnacctaccctngacatacagtgaatgatgcagagatgcatyagtgccttcgggaacactgatacaggtgctgcatggctgtcgtcagctcgtgtcgtgagatgttgggtnaagtcccgtaacgagcgcaaccctngtccttagttgccagcacgtaaaggtgggaactctaaggagactgccggtgacaaaccggaggaaggcggggatgacgtcaagtcatcatrgccnttacgggtagggctacacacgtgctacaatggacgatacagagggaagcgaaggggtgacctngagccaatcttagaaagtygttcgtngtccggattggagtctgcaactcgactccatgaagtcggaatcgctagtaatcgcgaatcagcatgtcgcggtnaatacgttcccgggccttgtacacaccgcccgtcacaccatgggagtgggctgcaccagaagtagatagtctaaccttcggggggacgtgtaccacggt

SEQ ID NO: 1153 - DNA, 1546 bp, Legionella pneumophila
tgaactgaagagtttgatcctggctcagattgaacgctggcggcatgcttaacacatgcaagtcgaacggcagcattgtctagcttgctagacagatggcgagtggcgaacgggtgagtaacgcgtaggaatatgccttgaagagggggacaacttggggaaactcaagctaataccgcataatgtctgaggacgaaagctggggaccttcgggcctggcgctttaagattagcctgcgtccgattagctagttggtggggtaagggcctaccaaggcgacgatcggtagctggtctgagaggatgaccagccacactggaactgagacacggtccagactcctacgggaggcagcagtggggaatattggacaatgggggcaaccctgatccagcaatgccgcgtgtgtgaagaaggcctgagggttgtaaagcactttcagtggggaggagggttgataggttaagagctgattaactggacgttacccacagaagaagcaccggctaactccgtgccagcagccgcggtaatacggagggtgcgagcgttaatcggaattactgggggtaaagggtgcgtaggtggttgattaagttatctgtgaaattcctgggcttaacctgggacggtcagataatactggttgactcgagtatgggagagggtagtggaatttccggtgtagcggtgaattgcgtagagatcggaaggaacaccagtggcgaaggcggctacctggcctaatactgacactgaggcacgaaagcgtggggagcaaacaggattagataccctggtagtccacgctgtaaacgatgtcaactagctgttggttatatgaaaataattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaattttgcagagatgcattagtgccttcgggaacactgatacaggtgctgcatggctgtcgtcagctcgtgtcgtgagatgttgggttaagtcccgtaacgagcgcaacccttatccttagttgccagcatgtgatggtggggactctaaggagactgccggtgacaaaccggaggaaggcggggatgacgtcaagtcatcatggcccttacgggtagggctacacacgtgctacaatggccgatacagagggcggcgaaggggcgacctggagcaaatccttaaaagtcggtcgtagtccggattggagtctgcaactcgactccatgaagtcggaatcgctagtaatcgcgaatcagcatgtcgcggtgaatacgttcccgggccttgtacacaccgcccgtcacaccatgggagtgggttgcaccagaagtagatagtctaaccttcggggggacgtttaccacggtgtggttcatgactggggtgaagtcgtaacaaggtagccgtaggggaacctgcggctggatcacctccttac

SEQ ID NO: 1154 - DNA, 1362 bp, Legionella sp.
  D3923
catgcttaacacatgcaagtcgaacggcagcacggtctagcttgctagatgggtggcgagtggcgaacgggtgagtaacgcgtaggaatatgccttaaagtttgggataacatggggaaactcatgctaataccggatgagctctgaggaggaaagctggggaccgtaaggcctggcgctttaagattagcctgcgtccgattagctagttggtggggtaagggcctaccaaggcgacgatcggtagctggtctgagaggatgaccagccacactgggactgagacacggcccagactcctacgggaggcagcagtggggaatattggacaatgggggcaaccctgatccagcaatgccgcgtgtgtgaagaaggcctgagggttgtaaagcactttcagtggggaggaggattgattggttaagagctgattgattggacgttacccacagaagaagcaccggctaactccgtgccagcagccgcggtaatacggagggtgcgagcgttaatcggaattactgggcgtaaagggtgcgtaggtggttgtataagttagctgtgaaatccccgggctcaacctgggcaggtcagctaagactgtatgactcgagtataggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactagttgttggccttatgaatgaggttagtgacgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaactttgcagagatgcattggtgccttcgggagcactgatacaggtgctgcatggctgtcgtcagctcgtgtcgtgagatgttgggttaagtcccgtaacgagcgcaacccttatccttagttgccagcgcgtgatggtgggaactctaaggagactgccggtgacaaaccggaggaaggcggggatgacgtcaagtcatcatggcccttacgggtagggctacacacgtgctacaatggccggtacagagggcagcgaaggggcgacctggagcaaatcttgtaaagctggtcgtagtccggattggagtctgcaactcgactccatgaagtcggaatcgctagtaatcgcgaatcagcatgtcgcggtgaatacgttcccgggccttgtacacaccgc

SEQ ID NO: 1155 - DNA, 1203 bp, Legionella sp.
  D4088
catgcttaacacatgcaagtcgaacgagtggcgaacgggtgagtaatgcgtaggaatatgccttgaagagggggataacccggggaaactcgggctaataccgcataatgaaaggcgctttaagattagcctacgtccgattagctagttggtggggtaagggcctaccaaggctgtgatcggtagctggtctgagaggatggacagccacactgggactgagacacggcccagactcctacgggaggcagcagtggggaatattggacaatggggggaaccctgatccagcaatgccgcgtgtgtgaagaaggcctgagggttgtaaagcactatcggtggggaggatgacgttacccacagaagaagcaccggctaactccgtgccagcagccgcggtaatacggagggtgcgagcgttaatcggaattactgggcgtaaagggtgcgtaggtggttttttaagttatctgtgaaattcctgggcttaacctgggctggtcagataagactggaagacttgagtatgggagagggcagtggaatttccggtgtagcggtgaaatgcgtagagatcggaaggaacaccagtggcgaaggcggctgcctggcctgactgacactgaggcacgaaagcgtgggtagcgaacaggattagataccctggtagtccacgctgtaaacgatgtcaactagctgttggctagttagtggcgcagcaaacgcgataagttgaccgcctggggagtacggtcgcaagactaaaactcaaaggaattgacgggggcccgcacaagcggtggagcatgtggtttaattcgatgcaacgcgaagaaccttacctacccttgacatatacaggtgctgcatggctgtcgtcagctcgtgtcgtgagatgttgggttaagtcccgtaacgagcgcaacccttattcctagttaccagcacgtggggactctagggagactgccggtgacaaaccggaggaaggcggggacgacgtcaagtcatcatggcccttacgggtagggctacacacgtgctacaatggacggcagagggcggcgaaggggcgacctggagcgaatccttactgttcgtagtccggatggagtctggaactcgactccagaagtcggaatcgctagtaatcgcgaatcagcatgtcgcggtgaatacgttcccgggccttgtacacaccgc

SEQ ID NO: 1156 - DNA, 1423 bp, Legionella sp.
  H63
aagtcgaacggcagcattttctagcttgctaggaagatggcgagtggcgaacgggtgagtaacgcgtaggaatatgccttaaagagggggataacatggggaaactcatgctaataccgcataatttcttaggaaaaaagctggggaccgtaaggcctggcgctttaagattagcctgcgtccgattagctagttggtggggtaagggcctaccaaggcgacgatcggtagctggtctgagaggatggccagccacactgggactgagacacggcccagactcctacgggaggcagcagtggggaatattggacaatggggggaaccctgatccagcaatgccgcgtgtgtgaagaaggcctgagggttgtaaagcactttcagtggggaggagtgattgataggttaagagctaattgattggacgttacccacagaagaagcaccggctaactccgtgccagcagccgcggtaatacggagggtgcaagcgttaatcggaattactgggcgtaaagggtgcgtaggtggtttggtaagttagttgtgaaatccctgggcttaacctgggaactgcaactaagactgtcagactcgagtataggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactagctgttggtcttataaatgagattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaactttgcagagatgcattggtgccttcgggagcactgatacaggtgctgcatggctgtcgtcagctcgtgtcgtgagatgttgggttaagtcccgtaacgagcgcaacccttgtccttagttgccagcatgtaatggtggggactctaaggagactgccggtgacaaaccggaggaaggcggggatgacgtcaagtcatcatggcccttacgggtagggctacacacgtgctacaatggccggtacagagggcagcgaaggggtgacctggagcaaatcttttaaagctggtcgtagtccggattggagtctgcaactcgactccatgaagtcggaatcgctagtaatcgcgaatcagcatgtcgcggtgaatacgttcccgggccttgtacacaccgcccgtcacaccatgggagtgggttgcaccagaagtagatagtctaacctttggggggacgtttaccacggtgtgatt

SEQ ID NO: 1157 - DNA, 1508 bp, Legionella sp.
  NML 93L054
ggctcagattgaacgctggcggcatgcttaacacatgcaagtcgaacggcagcatggtccagcttgctggactgatggcgagtggcgaacgggtgagtaatgcgtaggaatatgccttgaagagggggataacccggggaaactcgggctaataccgcataatctcttaggaggaaagctggggaccttatggcctggcgctttaagattagcctacgtccgattagctagttggtggggtaagggcctaccaaggctgtgatcggtagctggtctgagaggatggacagccacactgggactgagacacggcccagactcctacgggaggcagcagtggggaatattggacaatggggggaaccctgatccagcaatgccgcgtgtgtgaagaaggcctgagggttgtaaagcactatcggtggggaggaagtttgattggttaagagctgattggattgacgttacccacagaagaagcaccggctaactccgtgccagcagccgcggtaatacggagggtgcgagcgttaatcggaattactgggcgtaaagggtgcgtaggtggttttttaagttatctgtgaaattcctgggcttaacctgggctggtcagataagactggaagacttgagtatgggagagggcagtggaatttccggtgtagcggtgaaatgcgtagagatcggaaggaacaccagtggcgaaggcggctgcctggcctgatactgacactgaggcacgaaagcgtgggtagcgaacaggattagataccctggtagtccacgctgtaaacgatgtcaactagctgttggctttatagataaagttagtggcgcagcaaacgcgataagttgaccgcctggggagtacggtcgcaagactaaaactcaaaggaattgacgggggcccgcacaagcggtggagcatgtggtttaattcgatgcaacgcgaagaaccttacctacccttgacatacagtggagcttgcagagatgcgagtgtgcctttgggaacactgatacaggtgctgcatggctgtcgtcagctcgtgtcgtgagatgttgggttaagtcccgtaacgagcgcaacccttattcctagttaccagcacgtgatggtggggactctagggagactgccggtgacaaaccggaggaaggcggggacgacgtcaagtcatcatggcccttacgggtagggctacacacgtgctacaatggacggtacagagggcggcgaaggggcgacctggagcgaatccttaaaagctgttcgtagtccggattggagtctggaactcgactccatgaagtcggaatcgctagtaatcgcgaatcagcatgtcgcggtgaatacgttcccgggccttgtacacaccgcccgtcacaccatgggagtgggctgcaccagaagtagatagtctaaccttcggggggacgtttaccacggtgtggttcatgactggggtgaagtcgtaacaaggtagccgtaggggaacctgcgg

SEQ ID NO: 1158 - DNA, 1362 bp, Legionella steelei
catgcttaacacatgcaagtcgaacggcagcatgatctagcttgctagattgatggcgagtggcgaacgggtgagtaacgcgtaggaatatgccttgaagtgggggacaacttggggaaactcaagctaataccgcataatgtctaaggacgaaagctggggaccttagggcctggcgctttaagattagcctgcgtccgattagctagttggtggggtaagggcctaccaaggcgacgatcggtagctggtctgagaggatgaccagccacactggaactgagacacggtccagactcctacgggaggcagcagtggggaatattggacaatgggggcaaccctgatccagcaatgccgcgtgtgtgaagaaggcctgagggttgtaaagcactttcagtagggaggaggattgctaggttaagagctaagtgattggacgttacctacagaagaagcaccggctaactccgtgccagcagccgcggtaatacggagggtgcaagcgttaatcggaattactgggcgtaaagcgtgcgtaggtggttaattaagttatctgtgaaatccctgggcttaacctgggcaggtcagatgatactggttgactcgagtatgggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgccgtaaacgatgtcaactagctgttggttatatgaaaataattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaattttgcagagatgcattagtgccttcgggaacactgatacaggtgctgcatggctgtcgtcagctcgtgtcgtgagatgttgggttaagtcccgtaacgagcgcaacccttgtccttagttgccagcacgtaatggtgggaactctaaggagactgccggtgacaaaccggaggaaggcggggacgacgtcaagtcatcatggcccttacgggtagggctacacacgtgctacaatgggtgatacagagggaagcgaaggggtgacctggagctaatcttagaaagtcgctcgtagtccggattggagtctgcaactcgactccatgaagtcggaatcgctagtaatcgcgaatcagcatgtcgcggtgaatacgttcccgggccttgtacacaccgc

SEQ ID NO: 1159 - DNA, 1482 bp, Leminorella grimontii
ggcggcaggcctaacacatgcaagtcgaacggcagcgggaagtagcttgctactttgccggcgagtggcggacgggtgagtaatgtctgggaaactgcccgatggagggggataactactggaaacggtagctaataccgcatgacgtcttcggaccaaagagggggaccttagggcctcttgccatcggatgtgcccagatgggattagctagtaggcggggtaatggcccacctaggcgacgatccctagctggtctgagaggatgaccagccacactgggactgagacacggcccagactcctacgggaggcagcagtggggaatattgcacaatgggggaaaccctgatgcagccatgccgcgtgtgtgaagaaggccttcgggttgtaaagcactttcagcgaggaggaaggggttgtatttaatacatgcaatcattgacgttactcgcagaagaagcaccggctaactccgtgccagcagccgcggtaatacggagggtgcaagcgttaatcggaattactgggcgtaaagcgcacgcaggcggttgattaagttagatgtgaaatccccgggcttaacctgggaactgcatttaaaactggtcagctagagtcttgtagaggggggtagaattccacgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgcggatcagaatgccgcggtgaatacgttcccgggccttgtacacaccgcccgtcacaccatgggagtgggttgcaaaagaagtaggtagcttaaccttcgggggggcgcttaccactttgtgatccatgactggggtgaagtcgtaacaaggtaaccgtaggggaa

SEQ ID NO: 1160 - DNA, 1516 bp, Leminorella richardii
attgaacgctggcggcaggcctaacacatgcaagtcgaacggtagcaggaagaagcttgcttctttgctgacgagtggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggcggggtaatggcccaccctaggcgacgatccctagctggtctgagaggatgaccagccacactgggactgagacacggcccagactcctacgggaggcagcagtggggaatattgcacaatgggcgcaagcctgatgcagccatgccgcgtgtgtgaagaaggccttcgggttgtaaagcactttcagcgaggaggaagggtgtggagttaataacttcatgcattgacgttactcgcagaagaagcaccggctaactccgtgccagcagccgcggtaatacggagggtgcaagcgttaatcggaattactgggcgtaaagcgcacgcaggcggttgattaagtcagatgtgaaatccccgggctcaacctgggaactgcatttgaaactggtcagctagagtcttgtagaggggggtagaattccacgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaagtttgcagagatgcgaatgtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcacaaagtacgtcgtagtccggattggagtctgcaactcgactccatgaagtcggaatcgctagtaatcgcggatcagaatgccgcggtgaatacgttcccgggccttgtacacaccgcccgtcacaccatgggagtgggatgcaaaagaagtaggtagcttaaccttcgggggggcgcttaccactttgtgtttcatgactggggtgaagtcgtaacaaggtaaccgtaggggaacctgcggttggatcacctcctta

SEQ ID NO: 1161 - DNA, 1511 bp, Leptospira borgpetersenii
aacacggagagtttgatcctggctcagaactaacgctggcggcgcgtcttaaacatgcaagtcaagcggagtagcaatactcagcggcgaacgggtgagtaacacgtgggtaatcttcctccgagtctgggataactttccgaaaggggagctaatactggatagtcccgagaggtcataggatttttcgggtaaagatttattgctcggagatgagcccgcgcccgattagctagttggtgaggtaatggctcaccaaggcgacgatcggtagccggcctgagagggtgttcggccacaatggaactgagacacggtccatactcctacgggaggcagcagttaagaatcttgctcaatggggggaaccctgaaagcagcgacgccgcgtgaacgatgaaaggtcttcggattgtaaagttcaataagcagggaaaaataagcagcgatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgcgggctcaactcgcagcctgcacttgaaactatgtgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaatcatgtagagatacatgagccttcgggccgcttcacaggtgctgcatggttgtcgtcagctcgtgtcgtgagatgttgggttaagtcccgcaacgagcgcaaccctcaccttatgttgccatcattcagttgggcactcgtaaggaactgccggtgacaaaccggaggaaggcggggatgacgtcaaatcctcatggcctttatgtctagggcaacacacgtgctacaatggccggtacaaagagtagccaactcgcgagggggagctaatctcaaaaagccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgcaaggaagcagactactaaggtgaaactcgtgaagggggtgaagtcgtaacaaggtagccgtatcggaaggtgcggctggatcacctccttt

SEQ ID NO: 1162 - DNA, 1293 bp, Leptospira broomii
aactaacgctggcggcgcgtcttaaacatgcaagtcgagcgagcggcgaacgggtgagtaacacgtgggtaatcttcctccgagtctgggataactttccgaaaggaaagctaataccggatagttaaagttgcttggagatgagcccgcggccgattagctagttggtgaggtaatggctcaccaaggcgacgatcggtagccggcctgagagggtgtccggccacaatggaactgagacacggtccatactcctacgggaggcagcagttaagaatcttgctcaatgggggaaaccctgaagcagcgacgccgcgtgaacgaagaaggtcttcggattgtaaagttcattaagcagggaaaatgatggtacctgcctaaagcaccggctaactacgtgccagcagccgcggtaatacgtatggtgcaagcgttgttcggaatcattgggcgtaaagggtgcgtaggcggatttgtaagtcaggtgtgaaaactgcgggctcaacccgtggcctgcacttgaaactacaagtctggagtttgggagaggcaagtggaattccaggtgtagcggtgaaatgcgtagatatctggaggaacaccagtggcgaaggcgacttgctggctcaactgacgctgaggcacgaaagcgtgggtagtaaacgggattagataccccggtaatccacgccctaaacgttgtctaccagttgttggggcctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctgggcttgacatgcacaggtgctgcatggttgtcgtcagctcgtgtcgtgagatgttgggttaagtcccgcaacgagcgcaacccctatcgtatgttgctaccatgggcactcgtacgaaactgccggtgacaaaccggaggaaggcggggatgacgtcaaatcctcatggcctttatgtccagggccacacacgtgctacaatggccgacagagggtcgccaactcgcaagagggagctaatctctatcggtcccagttcggatggggtctgcaactcgaccccagaagtcggaatcgctagtaatcgcggatcagcatgccgcggtgaatacgttcccggaccttgtacacaccgcccgtcacaccacctgagtggggagcacccgaagtggtttgttagacagactactaaggtgaaactcgtaaagggggtg

SEQ ID NO: 1163 - DNA, 1508 bp, Leptospira interrogans
aacacggagagtttgatcctggctcagaactaacgctggcggcgcgtcttaaacatgcaagtcaagcggagtagcaatactcagcggcgaacgggtgagtaacacgtgggtaatcttcctctgagtctgggataactttccgaaagggaagctaatactggatggtcccgagagatcataagatttttcgggtaaagatttattgctcggagatgagcccgcgtccgattagctagttggtgaggtaaaggctcaccaaggcgacgatcggtagccggcctgagagggtgttcggccacaatggaatgagacacggtccatactcctacgggaggcagcagttaagaatcttgctcaatggggggaaccctgaagcagcgacgccgcgtgaacgatgaaggtcttcggattgtaaagttcagtaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgcgggctcaactcgcagcctgcacttgaaactatgtgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaatcatgtagagatacatgagccttcgggccgcttcacaggtgctgcatggttgtcgtcagctcgtgtcgtgagatgttgggttaagtcccgcaacgagcgcaaccctcaccttatgttgccatcattcagttgggcactcgtaaggaactgccggtgacaaaccggaggaaggcggggatgacgtcaaatcctcatggcctttatgtctagggcaacacacgtgctacaatggccggtacaaagggtagccaactcgcgagggggagctaatctcaaaaatccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgcaaggaagcagactactaaggtgaaactcgtgaagggggtgaagtcgtaacaaggtagccgtatcggaaggtgcggctggatcacctccttt

SEQ ID NO: 1164 - DNA, 1348 bp, Leptospira licerasiae
caagtcgagcggagtagcaatacttagcggcgaacgggtgagtaacacgtgggtaatcttcctccgaatctgggataactttccgaaaggaaagctaataccggatagttctattggatcacaggatttgatagataaaggtttactgttcggagatgagcccgcggccgattagctagttggtgaggtaatggctcaccaaggcgacgatcggtagccggcctgagagggtgtccggccacaatggaactgagacacggtccatactcctacgggaggcagcagttaagaatcttgctcaatgggcgcaagcctgaagcagcgacgccgcgtgaacgaagaaggtcttcggattgtaaagttcagtaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgggggctcaaccctcagcctgcacttgaaactatgtgtctggagtttgggagaggcaagtggaattccaggtgtagcggtgaaatgcgtagatatctggaggaacaccagtggcgaaggcgacttgctggctcaaaactgacgctgaggcacgaaagcgtgggtagtaaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctgggcttgacatggagtggaatcatatagagatatatgagccttcgggccgcttcacaggtgctgcatggttgtcgtcagctcgtgtcgtgagatgttgggttaagtcccgcaacgagcgcaacccctatcgtatgttgctaccatttagttgggcactcgtacgaaactgccggtgacaaaccggaggaaggcggggatgacgtcaaatcctcatggcctttatgtccagggccacacacgtgctacaatggccgatacagagggttgccaactcgcaagagggagctaatctctaaaagtcggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggt

SEQ ID NO: 1165 - DNA, 1510 bp, Leptotrichia buccalis
agagtttgatcctggctcaggatgaacgctgacagaatgcttaacacatgcaagtctttggcgaatctgtgcttgcacaggctagccaaggcggacgggtgagtaacgcgtaaagaacttaccctgcagacagggataacagacggaaacgactgataatacctgatacaattgccagcacgcatgtgcccggcaatgaaaagtgatgctgcaggagagctttgcgtcctattagcttgttggtgaggtaatggctcaccaaggcgatgataggtagccggcctgagagggtgaacggccacaaggggactgagatacggcccttactcctacgggaggcagcagtggggaatattggacaatgggggcaaccctgatccagcaattctgtgtgcatgaagaaggttttcggattgtaaagtgctttcagcagggaagaagaaagtgacggtacctgcagaagaagcgacggctaaatacgtgccagcagccgcggtaatacgtatgtcgcaagcgttatccggaattattgggcataaagggcatctaggcggccagacaagtctggggtgaaaacttgcggctcaaccgcaagcctgccctggaaactgtttggctagagtgctggagaggtggacggaactgcacgagtagaggtgaaattcgtagatatgtgcaggaatgccgatgatgaagatagttcactggacggtaactgacgctgaagtgcgaaagctgggggagcgaacaggattagataccctggtagtcccagccgtaaacgatgattactgggtgtgggcatgaagagtgtccgtgccgaagctaatgcgataagtaatccgcctggggagtacggccgcaaggctgaaactcaaaggaattgacggggacccgcacaagcggtggagcatgtggtttaattcgacgcaacgcgaggaaccttaccagatcttgacatcctacgaatgcctgtgagaacaggcagtgccttcgggaacgtagagacaggtggtgcatggctgtcgacagctcgtgtcgtgagatgttgggttaagtcccgcaacgagcgcaacccctatcgctagttgccatcattaagttggggactctagcgagactgcctgcgaagagcaggaggaaggtggggatgacgtcaagtcatcatgccccttatgatctgggctacacacgtgctacaatggccggtacaaagagctgcaaaacggtaacgtttagccaatctttaaagccggtccaagttcggattgaagtctgcaactcgacttcatgaagccggaatcgctagtaatcgcagatcagcaatgctgcggtgaatacgttctcgggtcttgtacacaccgcccgtcacaccacgagagttgtttgcacctgaagccgccggtccaaccgtaaggaggaaggcgtctaaggtgtggatagtgattggggtgaagtcgtaacaaggtatccgtaccggaaggtgcggatggatcacctcctttctaag

SEQ ID NO: 1166 - DNA, 1294 bp, Leptotrichia sp.
  C1
gatgaacgctgacagaatgcttaacacatgcaagtctggcgagcggcggacgggtgagtaacgcgtaaggaacttgccctgcagtcagggataacagacggaaacgactgataagacctggtaaagaaaatgctgcaggagagccttgcgtcctattagcttgttggtggggtaacggcccaccaaggcaatgataggtagccggcctgagagggtggacggccacaaggggactgagatacggcccttactcctacgggaggcagcagtggggaatattggacaatgggggcaaccctgatccagcaattctgtgtgcacgatgaaggttttcggattgtaaagtgctttcagcagggaagatgacggtacctgcagaagaagcgacggctaaatacgtgccagcagccgcggtaatacgtatgtcgcaagcgttatccggaattattgggcataaagggcatctaggcggccagataagtctggggtgaaaacttgcggctcaaccgcaagcctgccctggaaactatgtggctagagtactggagaggtggacggaactgcacgagtagaggtgaaattcgtagatatgtgcaggaatgccgatggtgaagatagttcactggacggactgacgctgaagtgcgaaagctaggggagcaaacaggattagataccctggtagtcctagctgtaaacgatgattactgggtgtgggcatgtccgtgccgaagctaatgcgataagtaatccgcctggggagtacggccgcaaggctgaaactcaaaggaatagacggggacccgcacaagcggtggagcatgtggtttaattcgacgcaacgcgaggaaccttaccagatcttgacatcgacaggtggtgcatggctgtcgacagctcgtgtcgtgagatgttgggttaagtcccgcaacgagcgcaacccctattgctagttgccatcatgggaactctagcaagactgcctgcgaagagcaggaggaaggtggggatgacgtcaagtcatcatgccccttatgatctgggctacacacgtgctacaatggccggcagagagccgcaaggcggcaacgccaagccaatctttccggtccaagttcggatgaagtctgcaactcgacttcagaagctggaatcgctagtaatcgcagatcagcaatgctgcggtgaatacgttctcgggtcttgtacacaccgcccgtcacaccacgagagttgtctgcacctgaagctgccgtccaggaaagcatctaaggtgtggatagtgattggggtg

SEQ ID NO: 1167 - DNA, 1515 bp, Leptotrichia goodfellowii
ttgaatgaagagtttgatcctggctcaggatgaacgctgacagaatgcttaacacatgcaagtcgatggggaagaattaacttgttaatttggtaaccatggcggacgggtgagtaacgcgtaaagaacttacctttcagactgggataacagagggaaacttctgataagaccggatataattaattgattgcatgagagattaatgaaaagagatgctgaaagagagctttgcgtcctattagctagttggtaaggtaacggcttaccaaggcgatgataggtagccggcctgagagggtggacggccacaaggggactgagatacggcccttactcttacgggaggcagcagtggggaatattggacaatggaggagactctgatccagcaattctgtgtgcacgaagaaggttttcggattgtaaagtgctttcagtggggaagaaggaagtgacggtacccacagaagaagcgacggctaaatacgtgccagcagccgcggtaatacgtatgtcgcgagcgttatccggaattattgggcataaagggcatctaggcggacgatcaagtcaggggtgaaaacttgcggctcaactgtaagcttgcctttgaaactgattgtctagagtattggaaaggtgggcggaactacacgagtagaggtgaaattcgtagatatgtgtaggaatgccgatgatgaagatagctcactggacgataactgacgctgaagtgcgaaagctaggggagcgaacaggattagataccctggtagtcctagctgtaaacgatgatcactgggtgtgggcaggaagactgtctgtgccgaagcaaatgcgataagtgatccgcctggggagtacgaccgcaaggttgaaactcaaaggaattgacggggacccgcacaagcggtggagcatgtggtttaattcgacgcaacgcgaggaaccttaccagatcttgacatcctacgaacatgtatgaggatacatggtgccttcgggaacgtagagacaggtggtgcatggctgtcgacagctcgtgtcgtgagatgttgggttaagtcccgcaacgagcgcaacccttatcgttagttaccatcattaagttggggactctagcgagactgcctgcgaagagcaggaggaaggtggggatgacgtcaagtcatcatgccccttatgatctgggctacacacgtgctacaatgggcagtacagagaggagcgagatagtgatatggagcgaatcttgaaagctgttctaagttcggattgaagtctgcaactcgacttcatgaagttggaatcgctagtaatcgcaaatcagcaatgttgcggtgaatacgttctcgggtcttgtacacaccgcccgtcacaccacgagagttgtttgcacctgaagttactggtctaacttaggaggaaggtacctaaggtgtgaatagtgattggggtgaagtcgtaacaaggtatccgtaccggaaggtgcggatggatcacctcctttct

SEQ ID NO: 1168 - DNA, 1507 bp, Leptotrichia hofstadii
tgaagagtttgatcctggctcaggatgaacgctgacagaatgcttaacacatgcaagtctttggcgaatctgtgcttgcacaggctagccaaggcggacgggtgagtaacgcgtaaagaacttgccctgcagacagggataacagacggaaacgactgacaacacctgatacagttgccggcacgcatgtgcctggcaatgaaaagagatgctgcgggagagctttgcgtcctattagcttgttggcggggtaacggcccaccaaggcgatgataggtagccggcctgagagggtgaacggccacaaggggactgagatacggcccttactcctacgggaggcagcagtggggaatattggacaatgggggcaaccctgatccagcaattctgtgtgcacgatgaaggttttcggattgtaaagtgctttcagcagggaagaaggaagtgacggtacctgcagaagaagcgacggctaaatacgtgccagcagccgcggtaatacgtatgtcgcaagcgttatccggaattattgggcataaagggcatctaggcggccaggcaagtctggggtgaaaacttgcggctcaaccgcaagcctgccctggaaactgcctggctagagtgctggagaggtggacggaactgcacgagtagaggtgaaattcgtagatatgtgcaggaatgccgatgatgaagatagttcactggacggcaactgacgctgaagtgcgaaagctgggggagcgaacaggattagataccctggtagtcccagccgtaaacgatgattactgggtgtgggcatgaagagtgtccgtgccgaagcaaatgcgataagtaatccgcctggggagtacggccgcaaggctgaaactcaaaggaattgacggggacccgcacaagcggtggagcatgtggtttaattcgacgcaacgcgaggaaccttaccagatcttgacatcccacgtatgcctgcgagagcgggcagtgccttcgggaacgtggagacaggtggtgcatggctgtcgacagctcgtgtcgtgagatgttgggttaagtcccgcaacgagcgcaacccctatcgccagttgccatcattaagttggggactctggcgagactgcctgcgaagagcaggaggaaggtggggatgacgtcaagtcatcatgccccttatgatctgggctacacacgtgctacaatggccggtacagagagctgcgaagcggcaacgcccagcgaatcttcaaagccggtccaagttcggattgaagtctgcaactcgacttcatgaagctggaatcgctagtaatcgcagatcagcaatgctgcggtgaatacgttctcgggtcttgtacacaccgcccgtcacaccacgagagttgtctgcacctgaagctgccggtctaaccgcaaggaggaaggcatctaaggtgtggacagtgattggggtgaagtcgtaacaaggtatccgtaccggaaggtgcggatggatcacctcctt

SEQ ID NO: 1169 - DNA, 1485 bp, Leptotrichia shahii
gagtttgatyctggctcaggatgaacgctgacagaatgcttaacacatgcaagtctttggcgaagctgcgcttgcgcagacgagccaaggcggacgggtgagtaacgcgtaaggaacttgccctgcagacagggataacagacggaaacgactgacaagacctgatacagttgccggcacgcatgtgcctggcgatgaaaggagacgctgcaggagagccttgcgtcctattagcttgttggcggggtaatggcccaccaaggcgatgataggtagccggcctgagagggtggacggccacaaggggactgagatacggcccttactcctacgggaggcagcagtggggaatattggacaatgggggcaaccctgatccagcaattctgtgtgcacgaagaaggttttcggattgtaaagtgctttcagcagggaagaagaaagtgacggtacctgcagaagaagcgacggctaaatacgtgccagcagccgcggtaatacgtatgtcgcgagcgttatccggaattattgggcataaagggcatctaggcggccctgtaagtctagggtgaaaacctgcggctcaaccgcaggcctgccccggaaactacagggctagagtgctggagaggtggacggaactgcacgagtagaggtgaaattcgtagatatgtgcaggaatgccgatgatgaagatagttcactggacggcaactgacgctgaagtgcgaaagctaggggagcaaacaggattagataccctggtagtcctagctgtaaacgatgattactgggtgtgggcatgaagagtgtccgtgccgaagctaatgcgataagtaatccgcctggggagtacggccgcaaggctgaaactcaaaggaattgacggggacccgcacaagcggtggagcatgtggtttaattcgacgcaacgcgaggaaccttaccagatcttgacatcctgcgaaggcctgcgagagcaggccgtgccttcgggaacgcagagacaggtggtgcatggctgtcgacagctcgtgtcgtgagatgttgggttaagtcccgcaacgagcgcaacccctatcgctagttgccatcattaggttggggactctagcgagactgcctgcgaagagcaggaggaaggcggggatgacgtcaagtcatcatgccccttatgatctgggctacacacgtgctacaatggccggtacaaagagctgccaggcggcaacgccaagcgaatctttaaagccggtccaagttcggattgaagcctgcaactcggcttcatgaagctggaatcgctagtaatcgcagatcagcaatgctgcggtgaatacgttctcgggtcttgtacacaccgccgtcacaccacgagagttgtctgcacctgaagccgccggtccaaccgaaaggaggaaggcgtctaaggtgtggacagtgattggggtgaagtcgtaacaaggtatccgtaccggaaggtgc

SEQ ID NO: 1170 - DNA, 1506 bp, Leptotrichia sp.
  neutropenicPatient
tggagagtttgatcctggctcaggatgaacgctgacagaatgcttaacacatgcaagtcattggcgaagctgcgcttgcgcagtctagccaaggcggacgggtgagtaacgcgtaaggaacttgccctgcagacagggataacagacggaaacgactgataacacctggtattgtcaggctggcgcatgccggcctgatgaaaggagacgctgcaggagagccttgcgtcctattagctagttggtggggtaacggcccaccaaggcgatgataggtagccggcctgagagggtgaacggccacaaggggactgagatacggcccttactcctacgggaggcagcagtggggaatattggacaatgggggcaaccctgatccagcaattctgtgtgcacgaagaaggttttcggattgtaaagtgctttcagcagggaagaagaaagtgacggtacctgcagaagaagcgacggctaaatacgtgccagcagccgcggtaatacgtatgtcgcaagcgttatccggaattattgggcataaagggcatctaggccgccctgtaagtctagggtgaaaacctgcggctcaaccgcaggcctgccccggaaactacagggctagagtatcggagaggtggacggaactgcacgagtagaggtgaaattcgtagatatgtgcaggaatgccgatgatgaagatagttcactggacggtaactgacgctgaagtgcgaaagctaggggagcaaacaggattagataccctggtagtcctagctgtaaacgatgattactgggtgtgggcatgaagagtgtccgtgccgaagcaaatgcgataagtaatccgcctggggagtacggccgcaaggctgaaactcaaaggaattgacggggacccgcacaagcggtggagcatgtggtttaattcgacgcaacgcgaggaaccttaccagatcttgacatcctgcgaatgcccgtgagaacgggcagtgccttcgggaacgcagagacaggtggtgcatggctgtcgacagctcgtgtcgtgagatgttgggttaagtcccgcaacgagcgcaacccctatcgttagttgccatcattaagttggggactctagcgagactgcctgcgaagagcaggaggaaggtggggatgacgtcaagtcatcatgccccttatgatctgggctacacacgtgctacaatggccggtacagagagcagccaggcggcaacgccgagcgaatctttaaagccggtccaagttcggattgaagcctgcaactcggcttcatgaagctggaatcgctagtaatcgcagatcagcaatgctgcggtgaatacgttctcgggtcttgtacacaccgcccgtcacaccacgagagttgtctgcacctgaagctgctggtccaaccgcaaggaggaaggcatctaaggtgtggatagtgattggggtgaagtcgtaacaaggtatccgtaccggaaggtgcggytggatcacctcctt

SEQ ID NO: 1171 - DNA, 1363 bp, Leptotrichia sp.
  oral clone GT018
gagtttgattctggctcaggatgaacgctgacagaatgcttaacacatgcaagtctggcgagcggcggacgggtgagtaacgcgtaaggaacttgccctgcagtcagggataacagacggaaacgactgataagacctggtaaagaaaatgctgcaggagagccttgcgtcctattagcttgttggtggggtaacggcccaccaaggcgatgataggtagccggcctgagagggtggacggccacaaggggactgagatacggcccttactcctacgggaggcagcagtggggaatattggacaatgggggcaaccctgatccagcaattctgtgtgcacgatgaaggttttcggattgtaaagtgctttcagcagggaagatgacggtacctgcagaagaagcgacggctaactacgtgccagcagccgcggtaatacgtatgtcgcaagcgttatccggaattattgggcataaagggcatctaggcggccagataagtctggggtgaaaacttgcggctcaaccgcaagcctgccctggaaactatgtggctagagtactggagaggtggacggaactgcacgagtagaggtgaaattcgtagatatgtgcaggaatgccgatgatgaagatagttcactggacggactgacgctgaagtgcgaaagctaggggagcaaacaggattagataccctggtagtcctagctgtaaacgatgattactgggtgtgggcatgtccgtgccgaagctaatgcgataagtaatccgcctggggagtacggccgcaaggctgaaactcaaaggaattgacggggacccgcacaagcggtggagcatgtggtttaattcgacgcaacgcgaggaaccttaccagatcttgacatcgacaggtggtgcatggctgtcgacagctcgtgtcgtgagatgttgggttaagtcccgcaacgagcgcaacccctattgctagttgccatcatgggaactctagcaagactgcctgcgaagagcaggaggaaggtggggatgacgtcaagtcatcatgccccttatgatctgggctacacacgtgctacaatggctggcagagagatgcgacgcagcaatgccaagccaacctctccagtccaagttcggatgaagcctgcaactcggcttcagaagttggaatcgctagtaatcgcggatcagcaatgccgcggtgaatacgttctcgggccttgtacacaccgcccgtcacaccacgagagttgtctgcacctgaagctgccgtctaagaaggcatctaaggtgtggacagtgattggggtgaagtcgtaacaaggtatccgtaccggaaggtgcggctggatcacctcctt

SEQ ID NO: 1172 - DNA, 1362 bp, Leptotrichia sp.
  oral clone GT020
gagtttgatcctggctcaggatgaacgctgacagaatgcttaacacatgcaagtctttgcaaggcggacgggtgagtaacgcgtaaagaacttgccctgcagtctgggataacagacggaaacgactgataaaacctgatatagaaaatgctgcaggagagctttgcgtcctattagcttgttggtggggtaatggcccaccaaggcaatgataggtagccggcctgagagggtgaccggccacaaggggactgagatacggcccttactcctacgggaggcagcagtggggaatattggacaatgggggcaaccctgatccagcaattctgtgtgcacgaagaaggttttcggattgtaaagtgctttcagcagggaagatgactgtacctgcagaagaagcgacggctaaatacgtgccagcagccgcggtaatacgtatgtcgcaagcgttatccggaattattgggcataaagggcatctaggcggccagataagtctggggtgaaaacttgcggctcaaccgcaagcctgccctggaaactatatggctagagtactggagaggtggacggaactgcacgagtagaggtgaaattcgtagatatgtgcaggaatgccgatgatgaagatagttcactggacggactgacgctgaagtgcgaaagctaggggagcaaacaggattagataccctggtagtcctagctgtaaacgatgattactgggtgtgggcatgtctgtgccgaagctaatgcgataagtaatccgcctggggagtacggccgcaaggctgaaactcaaaggaattgacggggacccgcacaagcggtggagcatgtggtttaattcgacgcaacgcgaggaaccttaccagatcttgacatcgacaggtggtgcatggctgtcgacagctcgtgtcgtgagatgttgggttaagtcccgcaacgagcgcaacccctatcgttagttgccatcatgggaactctagcgagactgcctgcgaagagcaggaggaaggtggggatgacgtcaagtcatcatgccccttatgatctgggctacacacgtgctacaatggccggcaaaaagctgcaaaacggtaacgtttagccaatctttccggtccaagttcggatgaagtctgcaactcgacttcagaagctggaatcgctagtaatcgcagatcagcaatgctgcggtgaatacgttctcgggtcttgtacacaccgcccgtcacaccacgagagttgtctgcacctgaagctgccgtctaagaaggtatctaaggtgtggatagtgattggggtgaagtcgtaacaaggtatccgtaccggaaggtgcggctggatcacctcctt

SEQ ID NO: 1173 - DNA, 1363 bp, Leptotrichia sp.
  oral clone HE012
gagtttgattctggctcaggatgaacgctgacagaatgcttaacacatgcaagtctggcgagcggcggacgggtgagtaacgcgtaaagaacttgccctgcagacagggataacagacggaaacgactgataacacctgatacagaaaatgctgcgggagagctttgcgtcctattagcttgttggtgaggtaacggctcaccaaggcgatgataggtagccggcctgagagggtgaacggccacaaggggactgagatacggcccttactcctacgggaggcagcagtggggaatattggacaatgggggcaaccctgatccagcaattctgtgtgcacgaagaaggttttcggattgtaaagtgctttcagcagggaagatgacggtacctgcagaagaagcgacggctaattacgtgccagcagccgcggtaatacgtatgtcgcaagcgttatccggaattattgggcataaagggcatctaggcggccagacaagtctggggtgaaaacttgcggctcaaccgcaagcctgccctggaaactgtttggctagagtgctggagaggtggacggaactgcacgagtagaggtgaaattcgtagatatgtgcaggaataccgatgatgaagatagttcactggacggactgacgctgaagtgcgaaagctaggggagcgaacaggattagataccctggtagtcctagctgtaaacgatgattactgggtgtggacatgtccgtgccgaagcaaatgcgataattaatccgcctggggagtacggccgcaaggctgaaactcaaaggaattgacggggacccgcacaagcggtggagcatgtggtttaattcgacgcaacgcgaggaaccttaccagatcttgacatcgacaggtggtgcatggctgtcgacagctcgtgtcgtgagatgttgggttaagtcccgcaacgagcgcaacccctatcgttagttaccatcatggggactctagcgagactgcctgcgaagagcaggaggaaggtggggatgacgtcaagtcatcatgccccttatgatctgggctacacacgtgctacaatggccggcagagagctgcgaagcggcaacgcccagcgaatctttccggtccaagttcggatgaagtctgcaactcgacttcagaagctggaatcgctagtaatcgcagatcagcaatgctgcggtgaatacgttctcgggtcttgtacacaccgcccgtcacaccacgagagttgtttgcacctgaagctgccgtctaggaaggcatctaatgtgtggatagtgattggggtgaagtcgtaacaaggtatccgtaccggaaggtgcggttggaacacctcctt

SEQ ID NO: 1174 - DNA, 1362 bp, Leptotrichia sp.
  oral clone IK040
gagtttgatcctggctcaggatgaacgctgacagaatgcttaacacatgcaagtcgatggatggcggacgggtgagtaacgcgtaaagaacttgccggatggaccgggataacagctggaaacggctggcaagaccggatactgaaaatgccgtccgagagctttgcgtcctattagctggttggtaaggtgacggcttaccaaggcgatgataggtagccggcctgagagggtggacggccacaaggggactgagatacggcccttactcctacgggaggcagcagtggggaatattggacaatgggggcaaccctgatccagcaattctgtgtgcacgaagaaggttttcggatcgtaaagtgctttcagcagggaggatgactgtacctgcagaagaagcgacggctaaatacgtgccagcagccgcggtaatacgtatgtcgcgagcgttatccggaattattgggcataaagggcatctaggcggccgggtaagtccggggtgaaaactgctggctcaaccagcagcctgccttggaaactacccggcttgagtgctggagaggtggacggaactgcacgagtagaggtgaaattcgtagatatgtgcaggaatgccgatgatgaagatagttcactggacggactgacgctgaagtgcgaaagctaggggagcgaacaggattagataccctggtagtcctagctgtaaacgatgattactgggtgtgggcatgtccgtgccgaagctaatgcgataagtaatccgcctggggagtacggccgcaaggctgaaactcaaaggaattgacggggacccgcacaagcggtggagcatgtggtttaattcgacgcaacgcgaggaaccttaccagatcttgacatcgacaggtggtgcatggctgtcgacagctcgtgtcgtgagatgttgggttaagtcccgcaacgagcgcaacccctatcgctagttgccatcatggggactctagcgagactgcctgcgaagagcaggaggaaggtggggatgacgtcaagtcatcatgccccttatgatctgggctacacacgtgctacaatggctggcagagagatgcgacgcagcaatgccaagccaacctctccagtccaagttcggatgaagcctgcaactcggcttcagaagttggaatcgctagtaatcgcggatcagcaatgccgcggtgaatacgttctcgggtcttgtacacaccgcccgtcacaccacgagagttgtctgcacctgaagctgccgtctaagaaggcatctaaggtgtggacagtgattggggtgaagtcgtaacaaggtatccgtaccggaaggtgcggctggaacacctcctt

SEQ ID NO: 1175 - DNA, 1293 bp, Leptotrichia sp.
  oral clone P2PB_51 P1
gatgaacgctgacagaatgcttaacacatgcaagtcgatggatggcggacgggtgagtaacgcgtaaggaacttacctgcgggactgggataacggagggaaacttctgacaagaccggataaagaaagcgcctgcggagagtcttgcgtcctattagctagttggttgggtaacggctgaccaaggcgaagataggtagccggcctgagagggtggacggccacaaggggactgagatacggcccttactcctacgggaggcagcagtggggaatattggacaatgggggcaaccctgatccagcaattctgtgtgcacgaagaaggttttcggattgtaaagtgctttcagcagggaagatgacggtacctgcagaagaagcgacggctaaatacgtgccagcagccgcggtaatacgtatgtcgcgagcgttatccggaattattgggcataaagggcatctaggcggcctaacaagtcaggggtgaaaacctgcggctcaaccgcaggcctgcctttgaaactgtaaggctggagtaccggagaggtggacggaactgcacgagtagaggtgaaattcgtagatatgtgcaggaatgccgatgatgaagatagtccactggacggactgacgctgaagtgcgaaagccgggggagcgaacaggattagataccctggtagtcccggccgtaaacgatgattactgggtgtgggcatgtctgtgccgaagcgaatgcgataagtaatccgcctggggagtacggccgcaaggctggaactcaaaggaattgacggggacccgcacaagcggtggagcatgtggtttaattcgacgcaacgcgaggaaccttaccagatcttgacatcgacaggtggtgcatggctgtcgacagctcgtgtcgtgagatgttgggttaagtcccgcaacgagcgcaaccctttttgctagttaccatcatggggactctagcgagactgcctgcgaagagcaggaggaaggtggggatgacgtcaagtcatcatgccccttatgatctgggctacacacgtgctacaatgggctgcagagaggagcgaggtggtgacacggagcgaatcttgcagttcgaagttcggatgaagtctgcaactcgacttcagaagttggaatcgctagtaatcgcggatcagcaatgccgcggtgaatacgttctcgggtcttgtacacaccgcccgtcacaccacgagagttgtctgcacctgaagttactgtctaggaaggtacctaaggtgtggatagtgattggggtg

SEQ ID NO: 1176 - DNA, 1432 bp, Leptotrichia sp.
  oral taxon 223
gatgaacgctgacagaatgcttaacacatgcaagtctttggcgaatctgcgcttgcccaggctagccaaggcggacgggtgagtagcgcgtaaagaacttgccctgcagacagggataacagacggaaacgactgacaacacctgatacggttgccggcacgcatgtgccaggcaatgaaaagcgatgctgcaggagagctttgcgtcctattagcttgttggtgaggtaacggctcaccaaggcgacgataggtagccggcctgagagggtgaacggccacaaggggactgagatacggcccttactcctacgggaggcagcagtggggaatattggacaatgggggcaaccctgatccagcaattctgtgtgcacgaagaaggctttcgggctgtaaagtgctttcagcagagaagaagcaagtgacggtacctgcagaagaagcgacggctaaatacgtgccagcagccgcggtaatacgtatgccgcaagcgttatccggaattattgggcataaagggcatctaggcggccaggcaagtctggggtgaaaacctgcggctcaaccgcaggcctgccctggaaactgcgtggctagagtgctggagaggtggacggaactgcacgagtagaggtgaaattcgtagatatgtgcaggaatgccgatgatgaagatagttcactggacggcaactgacgctgaagtgcgaaagccgggggagcgaacaggattagataccctggtagtcccggccgtaaacgatgattactgggtgtgggcatgaagagtgtccgtgccgaagctaatgcgataagtaatccgcctggggagtacggccgcaaggctgaaactcaaaggaattgacggggacccgcacaagcggtggagcatgtggtttaattcgacgcaacgcgaggaaccttaccagatcttgacatcctgcggatgcccgtgagagcgggcagtgccctcgggaacgcagagacaggtggtgcatggctgtcgacagctcgtgtcgtgagatgttgggttaagtcccgcaacgagcgcaacccctatcgccagttgccatcattaggttggggactctggcgagactgcctgcgaagagcaggaggaaggtggggatgacgtcaagtcatcatgccccttatgatctgggctacacacgtgctaccatggccggtacagagagctgcgaggcggcgacgccaagcgaacctgcaaagccggtccaagttcggattgaagcctgcaactcggcttcatgaagctggaatcgctagtaatcgcagatcagcaatgctgcggtgaatacgttctcgggtcttgtacacaccgcccgtcacaccacgagagctgtctgcacctgaagccgccggtccaaccgcaagggggaaggcgtctaaggtgtggacagtgattgggg

SEQ ID NO: 1177 - DNA, 1450 bp, Leuconostoc carnosum
cgcggcgtgcctaatacatgcaagtcgaacgcacagcgaaaggtgcttgcacctttcaagtgagtggcgaacgggtgagtaacacgtggacaacctgcctcaaggctggggataacatttggaaacagatgctaataccgaataaaacttagtatcgcatgataccaggttaaaaggcgctacggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaaaagttaaggtagggaatgaccttagcctgacggtaccataccagaaagggacggctaaatacgtgccagcagccgcggtaatacgtatgtcccgagcgttatccggatttattgggcgtaaagcgagcgcagacggttggttaagtctgatgtgaaagcccggagctcaactccggaaaggcattggaaactggttaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagaaatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacctgcgaaggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatggaagtttgtaatgcccaaagccggtggcctaaccgtaaggagggaaccgtctaaggcaggacag

SEQ ID NO: 1178 - DNA, 1576 bp, Leuconostoc citreum
gaattcactagtgattagagtttgattaatggctcaggatgaacgctggcggcgtgcctaatacatgcaagtcgaacgcgcagcgagaggtgcttgcacctttcaagcgagtggcgaacgggtgagtaacacgtggataacctgcctcaaggctggggataacatttggaaacagatgctaataccgaataaaacttagtatcgcatgatatcaagttaaaaggcgccacggcgtcacctagagatggatccgcggtgcattagttagttggtggggtaaaggcttaccaagacgatgatgcatagccgagttgagagactgatcggccacattgggactgagacacggcccaaactcctacgggaggctgcagtagggaatcttccacaatgggcgcaagcctgatggagcaacgccgcgtgtgtgatgaaggctttcgggtcgtaaagcactgttgtatgggaagaaatgctaaaatagggaatgattttagtttgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaatggcattggaaactggttaacttgagtgttgtagaggtaagtggaactccatgtgtagcggtggaatgcgtagatatatggaagaacaccagtggcgaaggcggcttactggacaacaactgacgttgaggctcgaaagtgtgggtagcaaacaggattagataaccctggtagtccacaccgtaaacgatgaatactaggtgttaggaggtttccgcctcttagtgccgaagctaacgcattaagtattccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagttgggcactctagcgagactgccggtgacaaaccggaggaaggcggggacgacgtcagatcatcatgccccttatgacctgggctacacacgtgctacaatggcgtatacaacgagttgccaacctgcgaaggtgagctaatctcttaaagtacgtctcagttcagactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccttcgggagggagccgtctaaggcaggacagatgactggggtgaagtcgtaacaaggtaaccgtaaatcgaatttcccgcggccgccatggcggccggagctgratcgc

SEQ ID NO: 1179 - DNA, 1554 bp, Leuconostoc gasicomitatum
tttaaattgagagtttgatcctggctcaggatgaacgctggcggcgtgcctaatacatgcaagtcgaacgcacagcgaaaggtgcttgcacctttcaagtgagtggcgaacgggtgagtaacacgtggataacctacctcaaggttggggataacatttggaaacagatgctaataccgaataaaacttagtatcgcatgataccaggttaaaaggcgctacggcgtcacctagagatggatccgcggtgcattagttagttggtggggtaaaggcttaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagagtagggaatgactttagtttgacggtaccataccagaaagggacggctaaatacgtgccagcagccgcggtaatacgtatgtcccgagcgttatccggatttattgggcgtaaagcgagcgcagacggttaattaagtctgatgtgaaagcccggagctcaactccggaaaggcattggaaactggttaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacctgtgaaggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccgtaaggagggaaccgtctaaggcaggacagatgactggggtgaagtcgtaacaaggtagccgtaggagaacctgcggctggatcacctcctttct

SEQ ID NO: 1180 - DNA, 1474 bp, Leuconostoc inhae
ctggcggcgtgcctaatacatgcaagtcgaacgcacagcgaaaggtgcttgcacctttcaagtgagtggcgaacgggtgagtaacacgtggataacctacctcaaggttggggataacatttggaaacagatgctaataccgaatgagacttcttgttgcatgacaggaagttaaaaggcgctacggcgtcgcctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagagtagggaatgactttagtttgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaaaggcattggaaactggtcaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaagttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacctgtgaaggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccgtaaggagggaaccgtctaaggcaggacagatgactggggtgaagtcgtaaca

SEQ ID NO: 1181 - DNA, 1558 bp, Leuconostoc kimchii
ttaaattgagagtttgatcctggctcaggatgaacgctggcggcgtgcctaatacatgcaagtcgaacgcgcagcgagaggtgcttgcacctttcaagcgagtggcgaacgggtgagtaacacgtggataacctgcctcaaggctggggataacatttggaaacagatgctaataccgaataaaacttagtatcgcatgatataaagttaaaaggcgctacggcgtcacctagagatggatccgcggtgcattagttagttggtgaggtaaaggctcaccaagacaatgatgcatagccgagttgagagactgatcggccacattgggactgagacacggcccaaactcctacgggaggctgcagtagggaatcttccacaatgggcgcaagcctgatggagcaacgccgcgtgtgtgatgaaggctttcgggtcgtaaagcactgttgtatgggaagaacagctagaatagggaatgattttagtgtgacggtaccataccagaaagggacggctaaatacgtgccagcagccgcggtaatacgtatgtcccgagcgttatccggatttattgggcgtaaagcgagcgcagacggttgtttaagtctgatgtgaaagcccggagctcaactccggaaaggcattggaaactggacaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacctgcgaaggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccgtaaggagggaaccgtctaaggcaggacagatgactggggtgaagtcgtaacaaggtagccgtaggagaacctgcggctggatcacctcctttctaagga

SEQ ID NO: 1182 - DNA, 1451 bp, Leuconostoc lactis
ggcggcgtgcctaatacatgcaagtcgaacgcgcagcgaaaggtgcttgcacctttcaagcgagtggcgaacgggtgagtaacacgtggataacctgcctcaaggctggggataacatttggaaacagatgctaataccgaataaaacttagtatcgcatgatacaaagttgaaaggcgctacggcgtcacctagagatgggtccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttagggtcgtaaagcactgttgtatgggaagaaatgctagaatagggaatgattctagttcgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaatggcattggaaactggttaacttgagtgttgtagaggtaagtggaactccatgtgtagcggtggaatgcgtagatatatggaagaacaccagtggcgaaggcggcttactggacaacaactgacgttgaggctcgaaagtgtgggtagcaaacaggattagataccctggtagtccacaccgtaaacgatgaatactaggtgttaggaggtttccgcctcttagtgccgaagctaacgcattaagtattccgcctggggagtacgaccgcaaggttgaaactcaaaggaattgacggggacccgcacaagcggtggagcatgtggtttaattcgaagcaacgcgaagaaccttaccaggtcttgacatcctttgaagcttctagagatagaagtgttctcttcggagacaaagtgacaggtggtgcatggtcgtcgtcagctcgtgtcgtgagatgttgggttaagtcccgcaacgagcgcaacccttattgttagttgccagcattcagttgggcactctagcgagactgccggtgacaaaccggaggaaggcggggacgacgtcagatcatcatgccccttatgacctgggctacacacgtgctacaatggcgtatacaacgagttgccaacccgcgagggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccttatggagggagccgtctaaggcaggacaga

SEQ ID NO: 1183 - DNA, 1555 bp, Leuconostoc mesenteroides
ttcaaattgagagtttgatcctggctcaggatgaacgctggcggcgtgcctaatacatgcaagtcgaacgcatagcgaaaggtgcttgcacctttcaagtgagtggcgaacgggtgagtaacacgtggacaacctgcctcaaggctggggataacatttggaaacagatgctaataccgaataaaacttagtgtcgcatgacacaaagttaaaaggcgcttcggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagaataggaaatgattttagtttgacggtaccataccagaaagggacggctaaatacgtgccagcagccgcggtaatacgtatgtcccgagcgttatccggatttattgggcgtaaagcgagcgcagacggtttattaagtctgatgtgaaagcccggagctcaactccggaatggcattggaaactggttaacttgagtgcagtagaggtaagtggaactccatgtgtagcggtggaatgcgtagatatatggaagaacaccagtggcgaaggcggcttactggactgcaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgataaaccggaggaaggcggggacgacgtcagatcatcatgccccttatgacctgggctacacacgtgctacaatggcgtatacaacgagttgccaacccgcgagggtgagctaatctcttaaagtacgtctcagttcggattgtagtctgcaactcgactacatgaagtcggaatcgctagtaatcgcggatcagcacgccgcggtgaatacgttcccgggtcttgtacacaccgcccgtcacaccatgggagtttgtaatgcccaaagccggtggcctaaccttttaggaaggagccgtctaaggcaggacagatgactggggtgaagtcgtaacaaggtagccgtaggagaacctgcggctggatcacctcctttct

SEQ ID NO: 1184 - DNA, 1448 bp, Leuconostoc pseudomesenteroides
gcggcgtgcctaatacatgcaagtcgaacgcacagcgaaaggtgcttgcacctttcaagtgagtggcgaacgggtgagtaacacgtggacaacctgcctcaaggctggggataacatttggaaacagatgctaataccgaataaaactcagtgtcgcatgacacaaagttaaaaggcgctttggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagaatagggaatgattttagtttgacggtaccataccagaaagggacggctaaatacgtgccagcagccgcggtaatacgtatgtcccgagcgttatccggatttattgggcgtaaagcgagcgcagacggttaattaagtctgatgtgaaagcccggagctcaactccggaatggcattggaaactggttaacttgagtgcagtagaggtaagtggaactccatgtgtagcggtggaatgcgtagatatatggaagaacaccagtggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacccgcgagggtgagctaatctcttaaagtacgtctcagttcggattgtagtctgcaactcgactacatgaagtcggaatcgctagtaatcgcggatcagcacgccgcggtgaatacgttcccgggtcttgtacacaccgcccgtcacaccatgggagtttgtaatgcccaaagccggtggcctaaccttttagggggagccgtctaaggcaggaca

SEQ ID NO: 1185 - DNA, 1549 bp, Listeria grayi
gagagtttgatcctggctcaggacgaacgctggcggcgtgcctaatacatgcaagtcgaacgaatgaccttaggagcttgctcctttggtcgttagtggcggacgggtgagtaacacgtgggcaacctgcctgtaagattgggataactccgggaaaccggagctaataccgaataataatcagctccgcatggagcgggtttgaaaggcggcttcggctgtcacttacagatgggcccgcggtgcattagctagttggtggggtaaaggcctaccaaggcgacgatgcatcgccgacctgagagggtgatcggccacactgggactgagacacggcccagactcctccgggaggcagcagtagggaatcttccgcaatggacgaaagtctgacggagcaacgccgcgtgtgtgaagaaggttttcggatcgtaaagcactgttgttagagaagaacaaggataagagtaactgcttgtcccttgacggtatctaaccagaaagccacggctaactacgtgccagcagccgcggtaatacgtaggtggcaagcgttgtccggaattattgggcgtaaagcgcgcgcaggcggtttcttaagtctgatgtgaaagcccccggcttaaccggggagggtcattggaaactgggagacttagagtgcagaagaggagagtggaattccatgtgtagcggtgaaatgccgagatatatggaggaacaccagtggcgaaggcgactctctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgacggtgcaagccggaggaaggtggggatgacgtcaaatcatcatgccccttatgacctgggctacacacgtgctacaatggatgatacaaagggtcgcgaagccgcgaggtgaagctaatcccataaaatcattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttct

SEQ ID NO: 1186 - DNA, 1514 bp, Listeria innocua
agagtttgatcctggctcaggacgaacgctggcggcgtgcctaatacatgcaagtcgaacgaacggaggaagagcttgctcttccaatgttagtggcggacgggtgagtaacacgtgggcaacctgcccgtaagttggggataactccgggaaaccggggctaataccgaatgatagagtgtgacgcatgtcacactcttgaaagatggtttcggctatcgcttacagatgggcccgcggtgcattagctagttggtagggtaaaggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtatgaagaaggttttcggatcgtaaagtactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgcgcgcaggcggtcttttaagtctgatgtgaaagcccccggcttaaccggggagggtcattggaaactggaagactggagtgcagaagaggagagtggaattccccgtgtatcgctgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggatggtacaaagggtcgcgaagccgcgaggtggagccaatcccataaaaccattctcagttcggattgtaggctgcaactcgcctacatggagccggaatcgctagtaatcgcggatcagcatgccgcggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtaaccgta

SEQ ID NO: 1187 - DNA, 1487 bp, Listeria ivanovii
  modified_base (251)..(251): a, c, t, g, unknown or other
  modified_base (533)..(533): a, c, t, g, unknown or other
  modified_base (573)..(573): a, c, t, g, unknown or other
  modified_base (593)..(593): a, c, t, g, unknown or other
  modified_base (602)..(602): a, c, t, g, unknown or other
  modified_base (621)..(621): a, c, t, g, unknown or other
  modified_base (629)..(630): a, c, t, g, unknown or other
  modified_base (654)..(654): a, c, t, g, unknown or other
  modified_base (742)..(742): a, c, t, g, unknown or other
  modified_base (829)..(829): a, c, t, g, unknown or other
  modified_base (853)..(853): a, c, t, g, unknown or other
  modified_base (887)..(887): a, c, t, g, unknown or other
  modified_base (968)..(968): a, c, t, g, unknown or other
  modified_base (983)..(983): a, c, t, g, unknown or other
  modified_base (1025)..(1025): a, c, t, g, unknown or other
  modified_base (1052)..(1052): a, c, t, g, unknown or other
  modified_base (1057)..(1057): a, c, t, g, unknown or other
  modified_base (1060)..(1060): a, c, t, g, unknown or other
  modified_base (1091)..(1091): a, c, t, g, unknown or other
  modified_base (1171)..(1171): a, c, t, g, unknown or other
  modified_base (1193)..(1193): a, c, t, g, unknown or other
  modified_base (1325)..(1325): a, c, t, g, unknown or other
  modified_base (1371)..(1371): a, c, t, g, unknown or other
  modified_base (1401)..(1401): a, c, t, g, unknown or other
  modified_base (1444)..(1444): a, c, t, g, unknown or other
gagagtttgatcctggctcaggacgaacgctggcggcgtgcctaatacatgcaagtcgaacgaacggaggaagagcttgctcttccaatgttagtggcggacgggtgagtaacacgtgggcaacctgcctgtaagttggggataactccgggaaaccggggctaataccgaatgataagtagtgacgcatgtcatcactttgaaagatggtttcgctatcgcttacagatgggcccgcggtgcattagctngttggtagggtaaaggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtatgaagaaggttttcggatcgtaaagtactgttgttagagaagaacaaggataagagtaactgcttgtcccttgacggtatctaaccagaaagccacggctaactacgtgccagcagccgcggtnatacgtaggtggcaagcgttgtccggatttattgggcgtnaagcgcgcgcaggcggtctnttaagtctnatgtgaaagcccccggctnaaccgggnngggtcattggaaactggaagactngagtgcagaagaggagagtggaattccacgtgtagcggtgaaatgcgtagatatgtggaggaacaccagtggcgaaggcgactctctngtctgtaactgacgctgaggcgcgaaagcgtggggagcaaacaggattagataccctggtagtccacgccgtaaacgatgagtgctnagtgttagggggtttccgcccctnagtgctgcagctaacgcattaagcactccgcctngggagtacgaccgcaaggttgaaactcaaaggaattgacgggggccgcacaagcggtggagcatgtggtttaattcgaagnaacgcgaagaacctnaccaggtcttgacatcctttgaccactctggagacagagctntccttcggggacaaagtgacaggtggngcatngtngtcgtcagctcgtgtcgtgagatgttgggtnaagtcccgcaacgagcgcaacccttgattttagttgccagcatttagttgggcactctaaagtgactgccggtgcaagcnggaggaaggtggggatgacgtnaaatcatcatgccccttatgacctgggctacacacgtgctacaatggatggtacaaagggtcgcgaagccgcgaggtggagccaatcccataaaaccattctcagttcggattgtaggctgcaactcgcctncatgaagccggaatcgctagtaatcgcggatcagcatgccgcggtnaatacgttcccgggccttgtacacaccgcncgtcacaccacgagagtttgtaacacccgaagtcggtagggtnaccttttaggagccagccgccgaaggtgggacagatgattggg

SEQ ID NO: 1188 - DNA, 1556 bp, Listeria monocytogenes
attttaaagagagtttgatcctggctcaggacgaacgctggcggcgtgcctaatacatgcaagtcgaacgaacggaggaagagcttgctcttccaaagttagtggcggacgggtgagtaacacgtgggcaacctgcctgtaagttggggataactccgggaaaccggggctaataccgaatgatagaatgtggcgcatgccacgcttttgaaagatggtttcggctatcgcttacagatgggcccgcggtgcattagctagttggtagggtaatggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtatgaagaaggttttcggatcgtaaagtactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgcgcgcaggcggtcttttaagtctgatgtgaaagcccccggcttaaccggggagggtcattggaaactggaagactggagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggatagtacaaagggtcgcgaagccgcgaggtggagctaatcccataaaactattctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttctaa

SEQ ID NO: 1189 - DNA, 1555 bp, Listeria welshimeri
tattttaaagagagtttgatcctggctcaggacgaacgctggcggcgtgcctaatacatgcaagtcgaacgaacggaggaagagcttgctcttccaaagttagtggcggacgggtgagtaacacgtgggcaacctgcctgtaagttggggataactccgggaaaccggggctaataccgaataataagtggtggcgcatgccacggctttgaaagatggtttcggctatcgcttacagatgggcccgcggtgcattagctagttggtagggtaatggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtatgaagaaggttttcggatcgtaaagtactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgcgcgcaggcggtcttttaagtctgatgtgaaagcccccggcttaaccggggagggtcattggaaactggaagactggagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttaattttagttgccagcatttagttgggcactctaaagtgactgccggtgcaagccggaggaaggtggggatgacgtcaaatcatcatgccccttatgacctgggctacacacgtgctacaatggatggtacaaagggtcgcgaagccgcgaggtggagccaatcccataaaaccattctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttct

SEQ ID NO: 1190 - DNA, 1247 bp, Luteococcus sanguinis
aacgggtgagtaacacgtgagtaacctgccccaaactctgggataacagtcggaaacggctgctaataccggatatggaaaggcggtttgggatggactcgcggcctatcagcttgttggtgaggtagtggctcaccaaggcttcgacgggtagccggcctgagagggcgaccggccacattgggactgagatacggcccaaactcctacgggaggcagcagtggggaatattgcacaatgggcgaaagcctgatgcagcaacgccgcgtgcgggatgacggccttcgggttgtaaaccgctttcagcgcagacgatgacggtatgcgcagaagaagcaccggccaactacgtgccagcagccgcggtgatacgtagggtgcgagcgttgtccggaattattgggcgtaaagagcttgtaggcggtttgttgcgtcagaagtgaaaactcagggcttaaccctgagcctgcttctgatacgggcagactagaggaagttaggggagaacggaattcctggtggagcggtggaatgcgcagatatcaggaggaacaccggtggcgaaggcggttctctgggactcctgacgctgagaagcgaaagcgtggggagcaaacaggcttagataccctggtagtccacgccgtaaacggtgggtactaggtgtgggtcgatccgtgccgcagctaacgcattaagtaccccgcctggggagtacggccgcaaggctaaaactcaaaggaattgacggggccccgcacaagcggcggagcatgcggattaattcgatgcaacgcgaagaaccttacctgggtttgacatgcacaggtggtgcatggctgtcgtcagctcgtgtcgtgagatgttgggttaagtcccgcaacgagcgcaaccctcgtccaatgttgccagcggccggggactcattggagaccgccggggtcaactcggaggaaggtggggatgacgtcaagtcatcatgccccttatgtccagggcttcacgcatgctacaatggccggcaaagggctgcgaacctgcaagggtgagcgaatcccaaccggtctcagttcggatggggtctgcaactcgaccccagaagtcggagtcgctagtaatcgcagatcagcaacgctgcggtgaatacgttcccggggcttgtacacaccgcccgtcaagtcatgaaagtcggtaacacccgaagccggtgcctagggagccgtcgaaggtgggaccggtaattagg

SEQ ID NO: 1191 - DNA, 1438 bp, Lutispora thermophila
gacgaacgctggcggcgtgcctaacacatgcaagtcgaacggagatggtgggatagcttgctattttatcatcttagtggcggacgggtgagtaacacgtgggcaacctgccctaaagagggggataacaccgagaaatcggtgctaataccgcatgaaattagagtttcgcatgaagctttaatcaaaggagcaatccgctttaggatgggcccgcgtctgattagctagttggtgaggtaacggctcaccaaggcgacgatcagtagccgatctgagaggatgaccggccacactggaactgagacacggtccagactcctacgggaggcagcagtggggaatattgcacaatgggggaaaccctgatgcagcaacgccgcgtggaggaagaaggtcttcggattgtaaactcctgtcttctgggacgaaatatgacggtaccagaggaggaagccacggctaactacgtgccagcagccgcggtaatacgtaggtggcgagcgttgtccggaattactgggcgtaaagggcgcgtaggcggcctgttaagtcagatgtgaaaaccccgggctcaacctggggagtgcatttgaaactgatgggctagagtgtcggagagggaagcggaattcctagtgtagcggtgaaatgcgtagatattaggaggaacaccagtggcgaaggcggctttctggacgataactgacgctgaggcgcgaaagcgtggggagcaaacaggattagataccctggtagtccacgctgtaaacgatggatactaggtgtgggaggtatcgaccccttccgtgccgcagtaaacgcaataagtatcccgcctggggagtacggccgcaaggttgaaactcaaaggaattgacgggggcccgcacaagcagcggagcatgtggtttaattcgaagcaacgcgaagaaccttaccagagcttgacatctcctgcatagtccgtaatgggatgaagtccttcgggacaggaagacaggtggtgcatggttgtcgtcagctcgtgtcgtgagatgttgggttaagtcccgcaacgagcgcaacccttatacttagttgccatcattaagttgggcactctaagtagactgccggagacaattcggaggaaggtggggatgacgtcaaatcatcatgccccttatgttctgggctacacacgtgctacaatgggtataacaacgggaagcaagccagtgatggtaagcaaatccctaaaaagtactcccagttcagattgttctctgaaactcgagaacatgaagtcggagttgctagtaatcgcgaatcagcatgtcgcggtgaatacgttcccgggccttgtacacaccgcccgtcacaccatgggagttggaagcacccgaagccggtgacttaaccgcaaggagagagccgtcgaaggtgaagccaatga

SEQ ID NO: 1192 - DNA, 1356 bp, Lysinibacillus fusiformis
ggggaaaccggggctaataccgaataatctgtttcacctcatggtgaaacactgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatggtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaa

SEQ ID NO: 1193 - DNA, 1541 bp, Lysinibacillus sphaericus
agagtttgatcctggctcaggacgaacgctggcggcgtgcctaatacatgcaagtcgagcgaacagagaaggagcttgctcctttgacgttagcggcggacgggtgagtaacacgtgggcaacctaccttatagtttgggataactccgggaaaccggggctaataccgaataatctatttcacctcatggtgaattattgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgacactgtaagatatggtttccccttcgggggcacggtgacaggtggtgcatggattgtcgtcagctcgtgtcgtgagatgttgggttaagtcccgcaacgagcgcaaccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgtccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctt

SEQ ID NO: 1194 - DNA, 1547 bp, Macrococcus caseolyticus
agagtttgatcctggctcaggatgaacgctggcggcgtgcctaatacatgcaagtcgagcgaacggacgagagtgcttgcactctctgatgttagcggcggacgggtgagtaacacgtgggtaacctacctataagactgggataacttcgggaaaccggagctaataccggataatatttagcttcgcatgaagcaatagtgaaagacggttctgctgtcacttatagatggacccgcggtgtattagctagttggtgaggtaacggctcaccaaggcaacgatacatagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtaagggaagaacaagtacgttagtaactgaacgtaccttgacggtaccttaccagaaagccacggctaactacgtgccagcagccgcggtaatacgtaggtggcaagcgttatccggaattattgggcgtaaagcgcgcgtaggcggtctcttaagtctgatgtgaaagcccccggctcaaccggggagggtcattggaaactgggagacttgagtgcagaagaggagagtggaattccatgtgtagcggtgaaatgcgcagagatatggaggaacaccagtggcgaaggcggctctctggtctgtaactgacgctgaggtgcgaaagcgtggggatcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttatctttagttgccatcattaggttgggcactctagagagactgccggtgacaaaccggaggaaggtggggatgacgtcaaatcatcatgccccttatgatttgggctacacacgtgctacaatggatggtacaaagggcagcaaaaccgcgaggtcaagcaaatcccataaaaccattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacagatgattggggtgaagtcgtaacaaggtagccgtatcggaaggtgcggctggatcacctccttt

SEQ ID NO: 1195 - DNA, 1516 bp, Mannheimia haemolytica
agagtttgatcatggctcagattgaacgctggcggcaggcttaacacatgcaagtcgaacggtagcacataggagtttgctccttgggtgacgagtggcggacgggtgagtaatgcttgggaatctggcttatggagggggataactactggaaacggtagctaataccgcgtaatgtcttaggactaaagggtgggaccatttggccacctgccataagatgagcccaagtgggattaggtagttggtgaggtaaaggctcaccaagcccgcgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgacgaggaaggcgattgttttaatagaacagtcgattgacgttaatcacagaagaagcaccggctaactccgtgccagcagccgcggtaatacggggggtgcgagcgttaatcggaataactgggcgtaaagggcacgcaggcggttgtttaagtgaggtgtgaaagccccgggcttaacctgggaattgcatttcagactgaacaactagagtactttagggaggggtagaattccacgtgtagcggtgaaatgcgtagagatgtggaggaataccgaaggcgaaggcagccccttggaaatgtactgacgctcatgtgcgaaagcgtggggagcaaacaggattagataccctggtagtccacgccgtaaacgctgtcgatttggggattggggtttaactctggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatatgagagtgccttcgggaaccatgagacaggtgctgcatggctgtcgtcagctcgtgttgtgaaatgttgggttaagtcccgcaacgagcgcaacccttatcctttgttgccagcgattaggtcgggaactcaaaggagactgccggtgataaaccggaggaaggtggggatgacgtcaagtcatcatggcccttacgagtagggctacacacgtgctacaatggcgtatacagagggcggcgagccagcgatggggagcgaatctcagaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccgaaaggggggcgtttaccacggtatgattcatgactggggtgaagtcgtaacaaggtaaccgtaggggaacctgcg

SEQ ID NO: 1196 - DNA, 1300 bp, Marvinbryantia formatexigens
tggcggcgtgcttaacacatgcaagtcgagcgagcggcggacgggtgagtaacgcgtggataacctgccttatacagggggataacagccagaaatggctgctaataccgcataagaaaaagtggtataagatgggtccgcgttggattaggcagttggcggggtaaaggcccaccaaaccgacgatccatagccggcctgagagggtggacggccacattgggactgagacacggcccagactcctacgggaggcagcagtggggaatattgcacaatgggggaaaccctgatgcagcgacgccgcgtgggtgaagaagtatttcggtatgtaaagccctatcagcagggaagatgacggtacctgaccaagaagccccggctaactacgtgccagcagccgcggtaatacgtagggggcaagcgttatccggatttactgggtgtaaagggagcgtagacggccatgcaagtctggtgtgaaaggcgggggctcaacccccggactgcattggaaactgtatggcttgagtgccggagaggtaagcggaattcctggtgtagcggtgaaatgcgtagatatcaggaggaacaccagtggcgaaggcggcttactggacggactgacgttgaggctcgaaagcgtggggagcaaacaggattagataccctggtagtccacgccgtaaacgatgaataccaggtgtcggggcttcggtgccgcagcaaacgcactaagtattccacctggggagtacgttcgcaagaatgaaactcaaaggaattgacggggacccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctgttcccagtagccagcatatgggcactctggggagactgccagggataacctggaggaaggcggggatgacgtcaaatcatcatgccccttatgatctgggctacacacgtgctacaatggcgtgcagagggaagcgaacccgcgagggggagcaaatcccagaacgtcccagttcggatgtagtctgcaacccggctacagaagctggaatcgctagtaatcgcggatcagcatgccgcggtgaatacgttcccgggtcttgtacacaccgcccgtcacaccatgggagtcggaaatgcccgaagtcagtacccagggagctgccgaaggcggggccggtaactggggtgaagtcgtaacaa

SEQ ID NO: 1197 - DNA, 1450 bp, Massilia sp.
  CCUG 43427A
acgctggcggcatgctttacacatgcaagtcgaacggtaacagggagcttgctccgctgacgagtggcgaacgggtgagtaatatatcggaacgtacccagaagtgggggataacgtagcgaaagttacgctaataccgcatacgatccacggatgaaagtaggggaccttcgggccttatgcttttggagcggccgatatctgattagctagttggtagggtaaaggcctaccaaggcgacgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaacggtagaggctaatatcctttgctaatgacggtacctgaagaataagcaccggctaactacgtgccagcagccgcggtaatacgtagggtgcaagcgttaatcggaattactgggcgtaaagcgtgcgcaggcggttttgtaagtctgacgtgaaatccccgggctcaacctgggaattgcgttggagactgcaaggctagaatctggcagaggggggtagaattccacgtgtagcagtgaaatgcgtagagatgtggaggaacaccgatggcgaaggcagccccctgggtcaagattgacgctcatgcacsaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacggaatgccgaagagatttggcagtgctcgaaagagaaccgtaacacaggtgctgcatggctgtcgtcagctcgtgtcgtgagatgttgggttaagtcccgcaacgagcgcaacccttgtcattagttgctacattcagttgagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggatcgtagtctgcaactcgactacgtgaagttggaatcgctagtaatcgcggatcagcatgccgcggtgaatacgttcccgggtcttgtacacaccgcccgtcacaccatgggagcgggttttaccagaagtaggtagcttaaccgcaaggagggcgcttaccacggtaggattcgtgactgggg

SEQ ID NO: 1198 - DNA, 1342 bp, Megamonas funiformis
ctttgacataagcttccgcttgaagatgagcttgcgtctgattagctagttggtgagggtaaaggcccaccaaggcgacgatcagtagccggtctgagaggatgaacggccacattgggactgagacacggcccagactcctacgggaggcagcagtggggaatcttccgcaatgggcgaaagcctgacggagcaacgccgcgtgaacgatgaaggtcttaggatcgtaaagttctgttgttagggacgaaggataaggattataatacagtctttgtttgacggtacctaacgaggaagccacggctaactacgtgccagcagccgcggtaatacgtaggcggcaagcgttgtccggaattattgggcgtaaagggagcgcaggcgggaaactaagcggatcttaaaagtgcggggctcaaccccgtgatggggtccgaactggttttcttgagtgcaggagaggaaagcggaattcccagtgtagcggtgaaatgcgtagatattgggaagaacaccagtggcgaaggcggctttctggactgtaactgacgctgaggctcgaaagctagggtagcgaacgggattagataccccggtagtcctagccgtaaacgatggatactaggtgtgggaggtatcgactccttccgtgccggagttaacgcaataagtatcccgcctggggagtacggccgcaaggttgaaactcaaaggaattgacgggggcccgcacaagcggtggagtatgtggtttaattcgacgcaacgcgaagaaccttaccaagacttgacattgattgaaagacttagagataagttccttctcttcggagaacaagaaaacaggtggtgcatggctgtcgtcagctcgtgtcgtgagatgttgggttaagtcccgcaacgagcgcaacccctatactatgttgccagcatttcggatgggaactcatagtagactgccgcggacaacgcggaggaaggcggggatgacgtcaagtcatcatgccccttacgtcttgggctacacacgtactacaatgggatgaacagagggaagcgaaatcgcgaggtggagcggatccctaaaagcatctctcagttcggattgtaggctgaaactcgcctacatgaagtcggaatcgctagtaatcgcaggtcagcatactgcggtgaatacgttcccgggccttgtacacaccgcccgtcacaccacgaaagtcattcacacccgaagccggctaagggcctatggtaccgaccgtctaaggtgggggcgatgattggggtgaagtcgtaacaaggtagccgtatcggaaggtgcggctggatcacctcctta

SEQ ID NO: 1199 - DNA, 1518 bp, Megamonas hypermegale
cctggctcaggacgaacgctggcggcgtgcttaacacatgcaagtcgaacggggtgtttatttcggtaaacaccaagtggcgaacgggtgagtaacgcgtaagcaatctaccttcaagatggggacaacacttcgaaaggggtgctaataccgaatgaatgagagatgaccgcatggatatttctctaaaggaggcctctgaaaatgcttccgcttgaagatgagcttgcgtctgattagctagttggtgagggtaaaggcccaccaaggcgacgatcagtagccggtctgagaggatgaacggccacattgggactgagacacggcccagactcctacgggaggcagcagtggggaatcttccgcaatgggcgaaagcctgacggagcaacgccgcgtgaacgaagaaggtcttaggatcgtaaagttctgttgttaggggcgaagggcaacattttgaataagggtgttgtttgacggtacttaacgaggaagccacggctaactacgtgccagcagccgcggtaatacgtaggcggcaagcgttgtccggaattattgggcgtaaagggagcgcaggcgggaagttaagcggactttaaaagtgcggggctcaaccccgtgagggggtccgaactgactttcttgagtgcaggagagggaagcggaattcctagtgtagcggtgaaatgcgtagatattaggaagaacaccagtggcgaaggcggctttctggactgtaactgacgctgaggctcgaaagctagggtagcgaacgggattagataccccggtagtcctagccgtaaacgatggatactaggtgtgggaggtatcgaccccttccgtgccggagttaacgcaataagtatcccgcctggggagtacggccgcaaggttgaaactcaaaggaattgacgggggcccgcacaagcggtggagtatgtggtttaattcgacgcaacgcgaagaaccttaccaagacttgacatcgactgacgtagttagagataagtatttttacttcggtaaacaggaagacaggtggtgcatggctgtcgtcagctcgtgtcgtgagatgttgggttaagtcccgcaacgagcgcaacccctatactatgttgccagcacgtaaaggtgggaactcatagtagactgccgcggacaacgcggaggaaggcggggatgacgtcaagtcatcatgccccttacgtcttgggctacacacgtactacaatgggatgaacagagggaagcgaagtcgcgaggcagagcggaaccctaaaagcatctctcagttcggattgcaggctgaaactcgcctgcatgaagtcggaatcgctagtaatcgcaggtcagcatactgcggtgaatacgttcccgggccttgtacacaccgcccgtcacaccacgaaagtcattcacacccgaagccggctaagggccgaaaggaaccgaccgtcgaaggtgggggcgatgattggggtgaagtcgtaacaaggtagccgtatcggaagg

SEQ ID NO: 1200 - DNA, 1530 bp, Megasphaera elsdenii
  modified_base (895)..(895): a, c, t, g, unknown or other
agagtttgatcctggctcaggacgaacgctggcggcgtgcttaacacatgcaagtcgaacgagaagagatgagaagcttgcttcttatcgattcgagtggcaaacgggtgagtaacgcgtaagcaacctgcccttcagatggggacaacagctggaaacggctgctaataccgaatacgttctttttgtcgcatggcagagagaagaaagggaggctcttcggagctttcgctgaaggaggggcttgcgtctgattagctagttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgaacgatgacggccttcgggttgtaaagttctgttatacgggacgaatggcgtacgacggtcaatacccgtcgtaagtgacggtaccgtaagagaaagccacggctaactacgtgccagcagccgcggtaatacgtaggtggcaagcgttgtccggaattattgggcgtaaagggcgcgcaggcggcgtcgtaagtcggtcttaaaagtgcggggcttaaccccgtgaggggaccgaaactgcgatgctagagtatcggagaggaaagcggaattcctagtgtagcggtgaaatgcgtagatattaggaggaacaccagtggcgaaagcggctttctggacgacaactgacgctgaggcgcgaaagccaggggagcaaacgggattagataccccggtagtcctggcggtaaacgatggatactaggtgtaggaggtatcgaccccttctgtgccggagttaacgcaataagtatcccngcctggggagtacggccgcaaaggctgaaactcaaaggaattgacgggggcccgcacaagcggtggagtatgtggtttaattcgacgcacgcgaagaaccttaccaagccttgacattgattgctatgggtagagatacccagttcctcttcggaggacaagaaaacaggtggtgcacggctgtcgtcagctcgtgtcgtgagatgttgggttaagtcccgcaacgagcgcaacccctatcttctgttaccagcgagttaagtcggggactcaggagagactgccgcagacaatgcggaggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggtaaccttttggagccagccgtcgaaggtgggggcgatgattggggtgaagtcgtaacaaggtaaccg

SEQ ID NO: 1201 - DNA, 1328 bp, Megasphaera sp.
  C1
gacgaacgctggcggcgtgcttaacacatgcaagtcgaacgagtggcaaacgggtgagtaacgcgtaaacaacctgccctacggatggggacaacagctggaaacggctgctaataccgaatacggaaagtcgccggaggaggggtttgcgtctgattagctagttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttatacgggacgatgacggtaccgtaagagaaagccacggctaactacgtgccagcagccgcggtaatacgtaggtggcaagcgttgtccggaattattgggcgtaaagggcgcgcaggcggcttcttaagtctgtcttaaaagtgcggggcttaaccccgtgatgggatggaaactgggaagctagagtatcggagaggaaagcggaattcctagtgtagcggtgaaatgcgtagatattaggaggaacaccagtggcgaaagcggctttctggacgaactgacgctgaggcgcgaaagccaggggagcgaacgggattagataccccggtggtcctggccgtaaacgatgggtactaggtgtaggagcttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaagccttgacattaacaggtggtgcacggctgtcgtcagctcgtgtcgtgagatgttgggttaagtcccgcaacgagcgcaacccctatcttctgttaccagcacgtggggactcaggagagactgccgcagacaatgcgggggaaggcggggatgacgtcaagtcatcatgccccttatggcttgggctacacacgtactacaatggctcttagagggaggcgaaggagcgatccggagcaaaccccaagagtctcagttcggatgtaggctgcaactcgcctacagaagcaggaatcgctagtaatcgcaggtcagcatactgcggtgaatacgttcccgggccttgtacacaccgcccgtcacaccacgaaagtcattcacacccgaagccggtaggtagccagccgtcgaaggtgggggcgatgattggggtgaagtcgtaacaaggtagccgtatcggaaggtgc

SEQ ID NO: 1202 - DNA, 1567 bp, Megasphaera sp.
  type_1
tggagagtttgatcctggctcaggacgaacgctggcggcgtgcttaacacatgcaagtcgaacgagaggacatgggaagcttgcttcctatgaaatcgagtggcaaacgggtgagtaacgcgtaaacaacctgcccttcggatggggataacagccggaaacggctgctaataccgaatacgatcttttcgtcgcatgacggaaagaagaaaggatggcctctatacaaagctatcgccgaaggaggggtttgcgtctgattagctggttggaggggtaacggcccaacaaggcgatgatcagtagccggtctgagaggatgaacggccacattgggactgagacacggcccagactcctacgggaggcagcagtggggaatcttccgcaatggacgaaagtctgacggagcaacgccgcgtgagtgaagaaggtcttcggattgtaaaagctctgttatacgggacgaaaaagacggatgccaacagtatccgtccgtgacggtaccgtaagagaaagccacggctaactacgtgccagcagccgcggtaatacgtaggtggcaagcgttgtccggaattattgggcgtaaagggcgcgcaggcggttcggtaagtctgtcttaaaagtgcggggcttaaccccgtgaggggacggaaactgtcgaacttgagtgtcggagaggaaagcggaattcctagtgtagcggtgaaatgcgtagatattaggaggaacaccggtggcgaaagcggctttctggacgacaactgacgctgaggcgcgaaagcgtggggagcaaacaggattagataccctggtagtccacgccgtaaacgatggatactaggtgtaggaggtatcgaccccttctgtgccgtagttaacgctataagtatcccgcctggggagtacggccgcaaggttgaaactcaaaggaattgacgggggcccgcacaagcggtggagtatgtggtttaattcgacgcaacgcgaagaaccttaccaagccttgacattgatcgcaattttcagagatgagaagttcctcttcggaggacgagaaaacaggtggtgcacggctgtcgtcagctcgtgtcgtgagatgttgggttaagtcccgcaacgagcgcaacccctatcttctgttaccagcacgtaagggtggggactcaggagagactgccgcagacaatgcggaggaaggcggggatgacgtcaagtcatcatgccccttatggcttgggctacacacgtactacaatggctctaaatagagggaagcgaaggagcgatccggagcaaaacccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctggatcacctcctttct

SEQ ID NO: 1203 - DNA, 1554 bp, Megasphaera micronuciformis
tggagagtttgatcctggctcaggacgaacgctggcggcgtgcttaacacatgcaagtcgaacgagagcgtagagaaagcttgctttttctacaatctagtggcaaacgggtgagtaacgcgtaaacaacctgccctacggatggggacaacagctggaaacggctgctaataccgaatacgttccgaaagtcgcatgactgtcggaagaaaggatggcctctatttataagctatcgccggaggaggggtttgcgtctgattagctagttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttatacgggacgaataatcttgtggttaatacccataagaagtgacggtaccgtaagagaaagccacggctaactacgtgccagcagccgcggtaatacgtaggtggcaagcgttgtccggaattattgggcgtaaagggcgcgcaggcggcttcttaagtctgtcttaaaagtgcggggcttaaccccgtgatgggatggaaactgggaagctcagagtatcggagaggaaagcggaattcctagtgtagcggtgaaatgcgtagatattaggaggaacaccagtggcgaaagcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaagccttgacattgatcgcaaggagtagagatactctgttcttcttcggaagacgagaaaacaggtggtgcacggctgtcgtcagctcgtgtcgtgagatgttgggttaagtcccgcaacgagcgcaacccctatcttctgttaccagcacgtaacggtggggactcaggagagactgccgcagacaatgcggaggaaggcggggatgacgtcaagtcatcatgccccttatggcttgggctacacacgtactacaatggctcttaatagagggaggcgaaggagcgatccggagcaaaccccaaaaacagagtctcagttcggattgtaggctgcaactcgcctacatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctgg

SEQ ID NO: 1204 - DNA, 1419 bp, Megasphaera sp.
  BLPYG-07
atcctagagtttgatcatggctcaaggacgaacgctggcggcgtgcttaacaacatgcaagtcgaacgagaagagatgagaagcttgcttcttattgattcgagtggcaaacgggtgagtaacgcgtaagcaacctgccctctagatggggacaacagctggaaacggctgctaataccgaatacgttctttctgtcgcatggcagaaggaagaaagggaggctcttcggagctttcgctggaggaggggcttgcgtctgattagctagttggaggggtaacggcccaccaaggcgacgatcagtagccggtctgagaggatgaacgccacatggacacctgagacacggcccagactcctacgggaggcagcagtggggaatcttccgcaatggacgaaagtctgacggagcaacgccgcgtgaacgatgacggccttcgggttgtaaagttctgttatacgggacgaatggtacgacggtcaatacccgtcgtaagtgacggtaccgtaagagaaagccacggctaactacggtgccagcagccgcgcgtaatacgtaggtggcaagcgttgtcggattattgggcgtaagggcgcgcaggcggcgtcgtaagtcggtcttaaaagtgcggggcttaaccccgtgaggggaccgaaactgcgatgctagagtatcggagaggaaagcggaattcctagtgtagcggtgaaatgcgtagatattaggaggaacaccagtggcgaaagcggctttctggacgacaactgacgctgaggcgcgaaagccaggggagcaaacgggattagataccccggtagtcctggccgtaaacgtggatactggtgtaggaggtatcgaccccttctgtgccggagttaacgcaataagtatcccgcctggggagtacggccgcaaggctgaaactcaaaaggaattgacgggggcccgcacaagcggtggagtatgtggtttaattcgacgcaacgcgaagaaccttaccaagccttgacattgattgctaagggtagagataccctgttcctcttcggaggacaagaaaacaggtggtgcacggctgtcgtcagctcgtgtcgtgagatgttgggttaagtcccgcaacgagcgcaacccctatcttctgttaccagcgggttaagtcggggactcaggagagactgccgcagacaatgcggaggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaacccgcctgcatgaagcaggaatcgctagtaatcgcaggtcagcaaaatacggtgaatacgttcccgggccttgtacaca

SEQ ID NO: 1205 - DNA, 1566 bp, Megasphaera sp.
  UPII 199-6
tggagagtttgatcctggctcaggacgaacgctggcggcgtgcttaacacatgcaagtcgaacgagaggacatgggaagcttgcttcctatgaaatcgagtggcaaacgggtgagtaacgcgtaaacaacctgcccttcggatggggataacagccggaaacggctgctaataccgaatacgatcttttcgtcgcatgacggaaagaagaaaggatggcctctatacaaagctatcgccgaaggaggggtttgcgtctgattagctggttggaggggtaacggcccaacaaggcgatgatcagtagccggtctgagaggatgaacggccacattgggactgagacacggcccagactcctacgggaggcagcagtggggaatcttccgcaatggacgaaagtctgacggagcaacgccgcgtgagtgaagaaggtcttcggattgtaaagctctgttatacgggacgaaaaagacggatgccaacagtatccgtccgtgacggtaccgtaagagaaagccacggctaactacgtgccagcagccgcggtaatacgtaggtggcaagcgttgtccggaattattgggcgtaaagggcgcgcaggcggttcggtaagtctgtcttaaaagtgcggggcttaaccccgtgaggggacggaaactgtcgaacttgagtgtcggagaggaaagcggaattcctagtgtagcggtgaaatgcgtagatattaggaggaacaccggtggcgaaagcggctttctggacgacaactgacgctgaggcgcgaaagcgtggggagcaaacaggattagataccctggtagtccacgccgtaaacgatggatactaggtgtaggaggtatcgaccccttctgtgccgtagttaacgctataagtatcccgcctggggagtacggccgcaaggttgaaactcaaaggaattgacgggggcccgcacaagcggtggagtatgtggtttaattcgacgcaacgcgaagaaccttaccaagccttgacattgatcgcaattttcagagatgagaagttcctcttcggaggacgagaaaacaggtggtgcacggctgtcgtcagctcgtgtcgtgagatgttgggttaagtcccgcaacgagcgcaacccctatcttctgttaccagcacgtaagggtggggactcaggagagactgccgcagacaatgcggaggaaggcggggatgacgtcaagtcatcatgccccttatggcttgggctacacacgtactacaatggctctaaatagagggaagcgaaggagcgatccggagcaaaacccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctggatcacctcctttct

SEQ ID NO: 1206 - DNA, 1496 bp, Metallosphaera sedula
attccggttgatcctgccggacccgatcgctataggggtagggctaagccatgggagtcgtacgctctcgggaagagggcgtggcggacggctgagtaacacgtggctaacctgcccttgggatctggataaccccgggaaactggggctaatccggagcgggcaagggaatctggaatgatctcttgcctaaaagcctctcggctgatcccgtcgagaggcgcccaaggatggggctgcggcccatcaggctgttgggggagtaaaggtcccccaaaccgataacgggtaggggccgtgggagcgggagcccccagttgggcactgagacaagggcccaggccctacggggcgcaccaggcgcggaacgtccccaatgcgggaaaccgtgagggcgttacccctagtgccctcgcaagagggcttttctccactccagaaaggtggaggaataagcggggggcaagactggtgtcagccgccgcggtaataccagccccgcgagtgatcgggacgtttattgggcttaaagcgcccgtagccggcctgtaaagtcaccgtttaaagacccgggctcaactcggggaacggcggtgatacttacaggctagggggcgggagaggtcggaggtactcccggagtaggggcgaaatcctcagatcccgggaggaccaccagtggcgaaagcgtccggctagaacgcgcccgacggtgaggggcgaaagccggggtagcaaataggattagataccctagtagtcccggctgtagacgatgcaggctaggtgtcgcgtaggctttgtgcctgcgcggtgccgcaggaaaactggtaagcccgccgcctggggagtacggccgcaaggctgaaacttaaaggaattggcgggggagcaccacaaggggtggaacctgcggctcaattggagtcaacgcctggaatctcaccgggggagaccgcaggatgacggccaggctaacgaccttgccagactcgcggagaggaggtgcatggccgtcgccagctcgtgttgtgaaatgtccggttaagtccggcaacgagcgagacccccacttctagttggtaaccgtctctccggagacggtccacactagaaggactgccggtgttaaaccggaggaaggagggggccacggcaggtcagcatgccccgaaacttccgggccgcacgcgggttacaatggcagggacagcgggatccgaccccgagaggggaaggcaatcccgcaaaccctgcctcagttgggatcgagggctgaaactcgccctcgtgaacgaggaatccctagtaaccgcgggtcaacaacccgcggtgaatacgtccctgctccttgcacacaccgcccgtcgctccacccgagtggaggggaagtgaggcctcttgcccctcggggtgggaggtcgagcttctcctccgcgaggggggagaagtcgtaacaaggtagccgtaggggaacctgcggctggatcacctca

SEQ ID NO: 1207 - DNA, 1376 bp, Methanobacterium formicicum
  modified_base (619)..(619): a, c, t, g, unknown or other
gattaagccatgcaagtcgaacgatccttcggggtcgtggcgtacggctcagtaacacgtggataacctaaccttaggactgggataaccctgggaaactggggataataccggatatgtagggctgcctggaatggttccctattgaaatgttccgacgcctaaggatggatctgcggcagattaggtagttggcggggtaaatgcccaccaagccagtaatctgtacgggttgtgagagcaagagcccggagatggaacctgagacaaggttccaggccctacggggcgcagcaggcgcgaaacctccgcaatgcacgaaagtgcgacgggggaaacccaagtgccactcttaacggggtggcttttcttaagtgtaaaaagcttttggaataagagctgggcaagaccggtgccagccgccgcggtaacaccggcagctcaagtggtggccgtttttattgggcctaaagcgttcgtagccggcttgataagtctctggtgaaatctcacggcttaaccgtgagaattgctggagatactattaggcttgaggccgggagaggttagcggtactcccggggtaggggtgaaatcctataatcccgggaggaccacntgtggcgaaggcggctaactggaacgggcctgacggtgagtaacgaaagccaggggcgcgaaccggattagatacccgggtagtcctggccgtaaacgatgtggacttggtgttgggatggctccgagctgccccagtgccgaagggaagctgttaagtccaccgcctgggaagtacggtcgcaagactgaaacttaaaggaattggcgggggagcaccacaacgcgtggagcctgcggtttaattggattcaacgccggacatctcaccaggggcgacagcagaatgatagccaggttgatgaccttgcttgacaagctgagaggaggtgcatggccgccgtcagctcgtaccgtgaggcgtcctgttaagtcaggcaacgagcgagacccacgcccttagttaccagcggatccttcgggatgccgggcacactaaggggaccgccagtgataaactggaggaaggagtggacgacggtaggtccgtatgccccgaatcccctgggctacacgcgggctacaatggttaggacaatgggttccgacactgaaaggtggaggtaatctcctaaacctggccttagttcggattgagggctgtaactcgccctcatgaagctggaatgcgtagtaatcgcgtgtcataaccgcgcggtgaatacgtccctgctccttgcacacaccgcccgtcacgccacccaaaaagggtttggatgaggccatagtctttggttatggtcgaatctaggttcttt

SEQ ID NO: 1208 - DNA, 1359 bp, Methanobrevibacter acididurans
  modified_base (988)..(988): a, c, t, g, unknown or other
gatttctgtttgatcctggcagaagctactgctattgggattcgattaagccatgcaagtcgaaagaatttatattcttggcgtacggctcagtaacacgtggataacctacccttaggactgggataactctgggaaactggagataatactggatagatgatttttcctgtaattggtattttgttgaaatgttttttcgcctaaggatgggtctgcggccgattaggtagttggtgaggtaatggcttaccaagccgtttatcggtacgggttgtgagagcaagagcccggagatggaacctgagacaaggttccaggccctacggggcgcagcaggcgctaaacctccgcaatgtgagcaatcgcgacggggggatcccaagtgccattcttaacgggatggcttttcttaagtgtaaagagcttttggaataagagctgggcaagaccggtgccagccgccgcggtaacacccggcagctctagtggtagctgtttttattgggcctaaagcgttcgtagccggtttaataagtctttggtgaaatcctgttttttaactatgggaattgctgaggatactgttaggcttgaggtcgggagaggttagcggtactcccagggtaggggtgaaatcctgtaatcctgggaggaccacctgtggcgaaggcggctaactggaacgaacctgacggtgagggacgaaagctaggggcgcgaaccggattagatacccgggtagtcctagccgtaaacgatgcggactgggtgttgggatggctttgagctgtttcggtgccgaagggaagctgttaagtccgccgcctgggaagtacggtcgcaagactgaaacttaaaggaattggcgggggagcaccacaacgcgtggagcctgcggtttaattggattcaacgccggagatctcaccaggggcgacagcagtatgatggccaggttgatggccttgcttgacaagctgaagangaggtgcatggcccgccgtcagctcgtaccgtgaggagtcctgttaagtcaggcaacgagcgagaccccacgctcttagttaccagcgggatccttttttggatgccgggcacactaaggggaccgccagtgataaactggaggaaggagtggacgacggtaggtccgtatgccccgaatcccctgggctacacgcgggctacaatggctgagacaatgggttacgacgctgaaaagcggagttaatcctctaaacttagtcgtagttcggattgagggctgtaactcgccctcatgaagctggaatgcgtagtaatcgcgtgtcacaatcgcgcggtgaatacgtccctgctccttgcacacaccgcccg

SEQ ID NO: 1209 - DNA, 1268 bp, Methanobrevibacter arboriphilus
gctcagtaacacgtggataacctacccttaggactgggataaccctgggaaactggggctaatactggatagatggtttttttcctgtaatggtatttcgtctaaatgttttttttcgcctaaggatgggtctgcggccgattaggttgttggttaggtaatggcttaccaagccgtttatcggtacgggttgtgagagcaagagcccggagatggaacctgagacaaggttccaggccctacggggcgcagcaggcgcgaaacctccgcaatgtgagaaatcgcgacggggggaccccaagtgccattcttaacgggatggcttttcttaagtgtaaaaagcttttggaataagagctgggcaagaccggtgccagccgccgcggtaacaccggcagctctagtggtggccagttttattgggcctaaagcgttcgtagccggtttattaagtctctggtgaaatcccgtagcttaactatgggaattgctggagatactagtagacttgaggtcgggagaggttagaggtactcccagggtaggggtgaaatcctgtaatcctgggaggaccacctgtggcgaaggcgtctaactggaacgaacctgacggtgagggacgaaagctaggggcgcgaaccggattagatacccgggtagtcctagccgtaaacgatgcggacttggtgttagaatggctttgagccgctctagtgccgaagggaagctgttaagtccgtcgcctgggaagtacggtcgcaagactgaaacttaaaggaattggcgggggagcaccacaacgcgtggagcctgcggtttaattggattcaacgccggacatctcaccaggggcgacagcagtatgatggccaggttgatggccttgcttgacaagctgagaggaggtgcatggccgccgtcagctcgtaccgtgaggcgtcctgttaagtcaggcaacgagcgagacccacgcccttagttaccagcggatccttttttttggatgccgggcacactaaggggaccgccagtgataaattggaggaaggagtggacgacggtaggtccgtatgccccgaatcccctgggcaacacgcgggctacaatggctgagacaatgggttccgacattgaaaagtggaggtaatcctctaaacttagtcgtagttcggattgagggctgtaactcgccctcatgaagctggaatgcgtagtaatcgcgtgtcataatcgcgcggtgaatacgtccctgctccttgcacacaccg

SEQ ID NO: 1210 - DNA, 1364 bp, Methanobrevibacter curvatus
  modified_base (1272)..(1272): a, c, t, g, unknown or other
  modified_base (1289)..(1289): a, c, t, g, unknown or other
atttatttcgtggcgtacggctcagtaacacgtggataacctacccttaggactaggataaccctgggaaactggggctaatactggataggtgatttttcctgcaatggtatttcatttaaatgttcttatgttcgcctaaggatgggtctgcggccgattaggttgttggtggggtaatggcttaccaagccgattatcggtacgggttgtgagagcaagagcccggagatggaacctgagacaaggttccaggccctacggggcgcagcaggcgcgaaacctccgcaatgtgagcaatcgcgacggggggatcccaagtgccattcttaaaagggatggcttttcataagtgtaaaaagcttttggaataagagctggcaagaccggtgccagccgccgcggtaacaccggcagctctagtggtagccatttttattgggcctaaagcgttcgtagccggtttaataagtctttggtgaaagcctacagcttagctgtgggaattgctggagatactattagacttgaggtcgggagaggttagaggtactcccagggtaggggtgaaatcctgtaatcctgggaggaccacctgtggcgaaggcgtctaactggaacgaacctgacggtgagggacgagagctaggggcgcgagccggattagatacccgggcagtcctagccgtaaacgatgtggacttggtgttgggatggctttgagctgtttcagtgccgaagggaagctgttaagtccaccgcctgggaagtacggtcgcaagactgaaacttaaaggaattggcgggggagcaccacaacgcgtggagcctgcggtttaattggattctacgccggacatctcaccaggggcgacagcagtatgatggccaggttgatggtcttgcttgacaagctgagaggaggtgcatggccgccgtcagctcgtaccgtgaggcgtcctgttaagtcaggcaacgagcgagacccacgcccttagttaccagcggatccttcgggatgccgggcacactaaggggaccgccagtgataaactggaggaaggagtggacgacggtaggtccgtatgccccgaatcccctgggcaacacgcgggctacaatggctaagacaatgagttccgccactggaaagtgaaggtaatctcctaaacttagtcgtagtacggattgagggctgtaactcgccctcatgaagctggaatgcgtagtaatcgcgtgtcataatcgcgcggtgaatacgtccctgctccntgcacacaccgcccgtnacaccacccaaaaagggctgggatgaggctttgatcttaggttaaattcgaatctcggttttttgaggagggtga

SEQ ID NO: 1211 - DNA, 1314 bp, Methanobrevibacter cuticularis
  modified_base (431)..(431): a, c, t, g, unknown or other
  modified_base (966)..(966): a, c, t, g, unknown or other
aggctactgctattggggttcgaataagccatgcaagtcgaacgaatttatattcgtggcatacggctcagtaacacgtggataacctacccttaggactagaataaccctgggaaactggggctaatactggatagatgatttttcctgcaatggtatttcgtttaaatgttttttcgcctaaggatgggtctgcggccgaataggtagttggttaggtaatggcttaccaagccgcttatcggtacgggttgtgagagcaagagcccggagatggaacctgagacaaggttccaggccctacggggcgcagcaggcgcgaaacctccgcaatgtgagaaatcgcgacggggggaccccaagtgccattcttaacgggatggcatttgtgaggtgtaaaaagcttcaagaataagagctgggcaagaccnggtgccagccgccgcggtaacaccggcagctctagtggtagccatttttattgggcctaaagcgttcgtagccggtttaataagtctctggtgaaatcctgtagcttaactattggaattgctggagatactattagacttgaggtcgggagaggttagaggtactcccagggtaggggtgaaatcctgtaatcctgggaggaccacctgtggcgaaggcgtctaactggaacgaacctgacggtgagggacgaaagctaggggcgcgaaccgggttagatacccgggtagtcctagccgtaagcgatgcggacttggtgttggaatggctttgagccgctccagtgccgaagggaagctgttaagtccgccgcctgggaagtacggtcgcaagactgaaacttaaaggaattggcgggggagcactcaacgcgtggagcctgcggtttaattggattcaacgccggacatctcaccaggggcgacagcagtatgatggccaggttgatggccttgcttgacaagctgagaggangtgcatggccgccgtcagctcgtaccgtgaggcgtcctgttaagtcgggcaacgagcgagacccacgcccttagttaccagcggatccttttggatgccgggcacactaaggggaccgccagtgataaactggaggaaggagtggacgacggtaggtccgtatgccccgaatcccctgggcaacacgcgggctacaatggctaagacaatgggttccgacactggaaagtggaggtaatcctctaaacttagtcgtagttcggattgagggctgtaacccgcccccatgaagctggaatgcgtagtaatcgcgtgtcataatcgcgcggtgaatacgtccctgctcct

SEQ ID NO: 1212 - DNA, 1363 bp, Methanobrevibacter filiformis
  modified_base (1017)..(1017): a, c, t, g, unknown or other
aatttatattcgtggcgtacggctcagtaacacgtggataacctacccttaggaccaggataactctggaaactggagctaatactggataggcgatttttcctgcaattggtatttcgtttaaatgttttttcgcctgaggatgggtctgcgttcgattagattgttggtaaggtaatggcttaccaagtcgattatcggtacgggttgtgagagcaagagcctggagatggaacctgagacaaggttccaggccctacggggcgcagcaggcgcgaaacctccgcaatgtgagaaatcgcgacggggggaccccaagwgccattcttaacgggatggcttttcttaagtgtaaaaagcttttggaataagagctgggcaagaccgggccagccgccgcggtaacaccggcagctctagtggtagccatttttattgggcctaaagcgttcgtagctggtttaataagtctttggtgaaatcctatagcttaactgtgggaattgctggggatactattagacttgaggtcgggagaggttagcggtactctcagggtaggggtgaaatcctgtaatcctgagaggaccacctgtggcgaaggcggctaactggaacgaacctgacggtgagggacgaaagccaggggcgcgaaccggattagatacccgggtagtcctggccgtaaacgatgcggacttggtgttaggatggtcttgagccgttctagtgccgaagggaagctgttaagtccgccgcctgggaagtacggtcgcaagactgaaacttaaaggaattggcgggggagcaccacaacgcgtggagcctgcggtttaattggattcaacgccggacatctcaccaggggcgacagccgtatgatagccaggttgatgatcttgcttgacaagctgagaggaggtgcatggccgccgtcagctcgtaccgtgaggcgtcctgttaagtcaggcaacgagcgagacccacgcccttagttaccaacagatcctttattgnatgctgggcacactaaggggaccgccagtgataaactggaggaaggagtggacgacggtaggtccgtatgccccgaatcccctgggcaacacgcgggctacaatggctaagacaatgggttccgacattgaaaagtggaggtaatcccctaaacttggtcgtagttcggattgagggctgtaactcgccctcatgaagctggaatgcgtagtaatcgcgtgtcataatcgcgcggtgaatacgtccctgctccttgcgcacaccgcccgtcacaccacccaaaaagggcttggatgaggctttaatctttggttaaattcgaatctaggttttttgaggagggtga

SEQ ID NO: 1213 - DNA, 1328 bp, Methanobrevibacter gottschalkii
tgctactgctattgggattcgattaagccatgcaagtcgaacgagtttaggctcgtggcgtacggctcagtaacacgtggataacctacccttaggactgggataaccttgggaaactgaggataatactggataggcaatttttcctgtaatggttttttgtttaaatgttttttcgcctaaggatgggtctgcggccgattaggtagttggttaggtaatggcttaccaagcctttgatcggtacgggttgtgggagcaagagcccggagatggaacctgagacaaggttccaggccctacggggtgcagcaggcgcgaaacctccgcaatgtgagaaatcgcgacggggggatcccaagtgctattcttaacgggatagcttttctttagtgtaaagagcttttggaataagagctgggcaagaccggtgccagccgccgcggtaacaccggcagctctagtggtagcagtttttattgggcctaaagcgtccgtagccggtttaataagtctctggtgaaatcctgtagcttaactatgggaattgctggagatactattggacttgagaccgggagaggttagaggtactcccagggtagaggtgaaattctgtaatcctgggaggaccgcctgttgcgaaggcgtctgactggaacggttctgccggtgagggacgaaagttaggggcgcgaaccggattagatacccgggtagtcctaactgtaaacgatgcggacttggtgttggggtggctttgagctgcttcagtgccgaagggaagctgttaagtccgccgcctgggaagtacggtcgcgagactgatacttaraagaattggcgggggagcaccacaacacgtggagcctgcggtttaattggattcaacgccggacatctcaccagaggcgacagctgtatgatagccaggttgatgactttgcttgactagctgagaggaggtgcatggccgccgtcagctcgtaccgtgaggcgtcctgttaagtcaggcaacgagcgagacccacgcccttagttaccagcttgtcctttttttggatgatagggcacactaaggggaccgcctatgataaataggaggaaggagtggacgacggtaggtccgtatgccccgaatcctctgggcaacacgcgggctacaatggctgggacaatgggttccgacaccgaaaggtggaggtaatcctctaaacttagtcgtagttcggattgaggactgtaactcgttctcatgaagctggaatgcgtagtaatcgcgtatcactattgcgcggtgaatacgtcccttggtccttgcacacacc

SEQ ID NO: 1214 - DNA, 1262 bp, Methanobrevibacter millerae
gctcagtaacacgtggataacctacccttaggaccgggataaccttgggaaactgaggataatactggataggcaattattcctggaatggttttttgtttaaatgttttttcgcctaaggatgggtctgcggccgattaggtagttggttaggtaacggcttaccaagccattgatcggtacgggttgtgagagcaagagcccggagatggaacctgagacaaggttccaggccctacggggtgcagcaggcgcgaaacctccgcaatgtgagaaatcgcgacggggggatcccaagtgccattcttaacgggatggcttttcattagtgtaaagagcttttggaataagggctgggcaagaccggtgccagccgccgcggtaacaccggcagctctagtggtagcagtttttattgggcctaaagcgtccgtagccggtttaataagtctctggtgaaatcctgtagcttaactgtgggaattgctggagatactattagacttgagaccgggagaggttagaggtactcccagggtagaggtgaaattctgtaatcctgggaggaccgcctgttgcgaaggcgtctaactggaacggttctgacggtgagggacgaaagttaggggcgcgaaccggattagatacccgggtagtcctaaccgtaaacgatgcggacttggtgttggggtggctttgagctgctccagtgccgaagggaagctgttaagtccgccgcctgggaagtacggtcgcaagactgaaacttaaaggaattggcgggggagcaccacaacgcgtggagcctgcggtttaattggattcaacgccggacatctcaccagaggcgacagctgtatgatggccaagctgatgactttgcttgactagctgagaggaggtgcatggccgccgtcagctcgtaccgtgaggcgtcctgttaagtcaggcaacgagcgagacccacgcccttagttaccagcggatccttttttggatgccgggcacactaaggggaccgcctatgataaataggaggaaggagtggacgacggtaggtccgtatgccccgaatcctctgggcaacacgcgggctacaatggctgagacaatgggttccgacaccgaaaggtggaggtaatcctctaaacttagtcgtagttcggattgaggactgtaactcgttctcatgaagctggaatgcgtagtaatcgcgtatcactattgcgcggtgaatacgttcctgctccttgcacacaccg

SEQ ID NO: 1215 - DNA, 1266 bp, Methanobrevibacter olleyae
tgctcagtaacacgtggataacctacccttaggactgggataaccctgggaaactggggctaataccggatagatgatttttttcctgtaatggtgttttgtttaaatgtttttttttcgcctaaggatgggtctgcggcagattaggtagttggttgggtaatggcttaccaagcctatgatctgtacgggttgtgagagcaagagcccggagatggaacctgagacaaggttccaggccctacggggcgcagcaggcgcgaaacctccgcaatgtgagaaatcgcgacggggggatcccaagtgccattcttaacgggatggcttttcttaagtgtaaaaagcttttggaataagagctgggcaagaccggtgccagccgccgcggtaacaccggcagctctagtggtagctgtttttattgggcctaaagcgttcgtagccggtttggtaagtcactggtgaaatcctgtagcttaactatgggaattgctggtgatactgttgaacttgaggtcgggagaggttagcggtactcccagggtagaggtgaaattctgtaatcctgggaggaccacctgtggcgaaggcggctaactggaacgaacctgacggtgagggacgaaagctaggggcgcgaaccggattagatacccgggtagtcctagccgtaaacgatgcggacttggtgttgggatggctttgagccgctccggtgccgaagggaagctgttaagtccgccgcctgggaagtacggtcgcaagactgaaacttaaaggaattggcgggggagcaccacaacgcgtggagcctgcggtttaattggattcaacgccggacatctcaccaggagcgacagctgtatgattaccaggctgatgaccttgtttgactagctgagaggaggtgcatggccgccgtcagctcgtaccgtgaggcgtcctgttaagtcaggcaacgagcgagaccacgcccttagttaccatcagattctttggaatgctgggcacactaaggggaccgccagtgataaattggaggaaggagtggacgacggtaggtccgtatgccccgaatcccctgggctacacgcgggctacaatggctgggacaatgggttccgacgccgaaaggtggaggtaatcttttaaacctagtcgtagttcggattgagggctgtaactcgccctcatgaagctggaatgcgtagtaatcgcgtgtcacaatcgcgcggtgaatacgtccctgctccttgcacacaccga

SEQ ID NO: 1216 - DNA, 1475 bp, Methanobrevibacter oralis
ccggttgatcctgccagatgctactgcyattgggattcgattaagccatgcaagtcgaacgagtttagactcgtggcgtacggctcagtaacacgtggataacctacccttaggactgggataaccctgggaaactggggataatactggataggcaattagtcctgtaatggttttttgtttaaatgttttttcgcctaaggatgggtctgcggccgattaggtagttggttaggtaatggcttaccaagccgttgatcggtacgggttgtgagagcaagagcccggagatggaacctgagacaaggttccaggccctacggggcgcagcaggcgcgaaacctccgcaatgtgagaaatcgcgacggggggatcccaagtgccattcttaacgggatggcttttcattagtgtaaagagcttttggaataagagctgggcaagaccggtgccagccgccgcggtaacaccggcagttctagtggtagcagttattattgggcctaaagcgtccgtagccggtttaataagtctctggtgaaatcctgtagcttaactatgggaattgctggagatactattagacttgagatcgggagaggttagaggtactcccagggtagaggtgaaattctgtaatcctgggaggaccgcctgttgcgaaggcgtctaactggaacgattctgacggtgagggacgaaagttaggggcgcgaaccggattagatacccgggtagtcctaactgtaaacgatgcggacttggtgttgggatggctttgagctgtctcagtgccgaagggaagctgttaagtccgccgcctgggaagtacggtcgcaagactgaaacttaaaggaattggcgggggagcaccacaacgcgtggagcctgcggtttaattggattcaacgccggacatctcaccagaggcgacagctgtatgatagccaggttgatgactttgcttgactagctgagaggaggtgcatggccgccgtcagctcgtaccgtgaggcgtcctgttaagtcaggcaacgagcgagacccacgcccttagttaccagcggattcttttttttgaagccgggcacactagggggaccgcctatgataaataggaggaaggagtggacgacggtaggtccgtatgccccgaatccacagggyaacacgcgggctacaatggctgagacaatgggttccgacaccgaaaggtggaggtaatcctctaaacttagtcgtagtccggattgaggactgtaactcgttctcatgaagctggaatgcgtagtaatcgcgtgtcacaatcgcgcggtgaatacgtccctgctccttgcacacaccgcccgtcacgccacccaaaaagggattggatgaggatgtaatgttttttgttatattcgaatctagtttttttaaggagggcgaagtcgtaacaaggtacggctaggggaacctgcggctggatcacctcc

SEQ ID NO: 1217 - DNA, 1260 bp, Methanobrevibacter ruminantium
gctcagtaacacgtggataacctacccttaggactgggataaccctgggaaactggggctaataccggatagataatttttcctggaatggtattttgtttaaatgttttttcgcctaaggatgggtctgcggcagattaggtagttggttaggtaatggcttaccaagcctatgatctgtacgggttgtgagagcaagagcccggagatggaacctgagacaaggttccaggccctacggggcgcagcaggcgcgaaacctccgcaatgtgagaaatcgcgacggggggatcccaagtgccattcttaacgggatggcttttcttaagtgtaaaaagcttttggaataagagctgggcaagaccggtgccagccgccgcggtaacaccggcagctctagtggtagctacttttattgggcctaaagcgttcgtagccggtttgataagtcactggtgaaatcctatagcttaactgtgggaattgctggtgatactgttgaacttgaggtcgggagaggttagcggtactcccagggtagaggtgaaattctgtaatcctgggaggaccacctgtggcgaaggcggctaactggaacgaacctgacggtgagggacgaaagccaggggcgcgaaccggattagatacccgggtagtcctggccgtaaacgatgcggacttggtgttgggatggctttgagccgctccggtgccgaagggaagctgttaagtccgccgcctgggaagtacggtcgcaagactgaaacttaaaggaattggcgggggagcaccacaacgcgtggagcctgcggtttaattggattcaacgccggacatctcaccaggagcgacagctgtatgattaccaggctgatgaccttgtttgactagctgagaggaggtgcatggccgccgtcagctcgtaccgtgaggcgtcctgttaagtcaggcaacgagcgagacccacgcccttagttaccatcagattctccggaatgctgggcacactaaggggaccgccagtgataaactggaggaaggagtggacgacggtaggtccgtatgccccgaatcccctgggctacacgcgggctacaatggctgggacaatgggttccgacgccgaaaggcgaaggcaatcttttaaacctagtcgtagttcggattgagggctgtaactcgccctcatgaagctggaatgcgtagtaatcgcgtgtcacaatcgcgcggtgaatacgtccctgctccttgcacacaccg

SEQ ID NO: 1218 - DNA, 1485 bp, Methanobrevibacter smithii
ttcaattctgtttgatcctggcagatgctactgctattgggattcgattaagccatgcaagtcgaacgagtttaggctcgtggcgtacggctcagtaacacgtggataacctacccttaggactgggataaccctgggaaactggggataatactggataggcaattattcctgtaatggttttttgtttaaatgttttttcgcctaaggatgggtctgcggccgattaggtagttggttaggtaatggcttaccaagcctttgatcggtacgggttgtgagagcaagagcccggagatggaacctgagacaaggttccaggccctacggggtgcagcaggcgcgaaacctccgcaatgtgagaaatcgcgacggggggatcccaagtgccattcttaacgggatggcttttcattagtgtaaagagcttttggaataagagctgggcaagaccggtgccagccgccgcggtaacaccggcagctctagtggtagcagtttttattgggcctaaagcgtccgtagccggtttaataagtctctggtgaaatcctgcagcttaactgtgggaattgctggagatactattagacttgagatcgggagaggttagaggtactcccagggtagaggtgaaattctgtaatcctgggaggaccgcctgttgcgaaggcgtctgactggaacgattctgacggtgagggacgaaagctaggggcgcgaaccggattagatacccgggtagtcctagctgtaaacgatgcggacttggtgttggggtggctttgagctgtcccagtgccgaagggaagctgttaagtccgccgcctgggaagtacggtcgcaagactgaaacttaaaggaattggcgggggagcaccacaacgcgtggagcctgcggtttaattggattcaacgccggacatctcaccagaggcgacagctgtatgatagccaggttgatgactttgcttgactagctgagaggaggtgcatggccgccgtcagctcgtaccgtgaggcgtcctgttaagtcaggcaacgagcgagacccacgctcttagttaccagcggatccttttttggatgccgggcacactaaggggaccgcctatgataaataggaggaaggagtggacgacggtaggtccgtatgccccgaatcctctgggcaacacgcgggctacaatggctgagacaatgggttccgacgccgaaaggcggaggtaatcctctaaacttagtcgtagttcggattgaggactgtaactcgttctcatgaagctggaatgcgtagtaatcgcgtgtcacaatcgcgcggtgaatacgtccctgctccttgcacacaccgcccgtcacgccacccaaaaagggattggatgaggatgtaatgttttgttatattcgaatctagtttttttaaggagggcgaagtcgtaacaaggtagccgtaggggaacctgcggctggatcacctccttacac

SEQ ID NO: 1219 - DNA, 1268 bp, Methanobrevibacter thaueri
  modified_base (6)..(8): a, c, t, g, unknown or other
  modified_base (607)..(607): a, c, t, g, unknown or other
  modified_base (610)..(611): a, c, t, g, unknown or other
  modified_base (868)..(868): a, c, t, g, unknown or other
  modified_base (1124)..(1124): a, c, t, g, unknown or other
  modified_base (1255)..(1255): a, c, t, g, unknown or other
  modified_base (1258)..(1258): a, c, t, g, unknown or other
aagccnnncaagtcgaacgaatttagattcgtggcgtacggctcagtaacacgtggataacctacccttaggaccgggataaccttgggaaactgaggataatactggataggcaatttttcctgtaatggttttttgtttaaatgttttttcgcctaaggatgggtctgcggccgattaggtagttggttaggtaatggcttaccaagccgttgatcrgaacgggttgtgagagcaagagcccggagatggaacctgagacaaggttccaggccctacggggcgcagcaggcgcgaaacctccgcaatgtgagaaatcgcgacggggggatcccaagtgccattcttaacgggatggcttttcattagtgtaaagagcttttggaataagagctgggcaagaccggtgccagccgccgcggtaacaccggcagctctagtggtaacaatttttattgggcctaaagcgtccgtagccggtttaataagtctctggtgaaatcctgtagcttaactgtgggaattgctggagatactattagacttgagaccgggagaggttagaggtactcccagggtagaggtgaaattctgtaatcctgggagnacnncctgttgcgaaggcgtctaactggaacggttctgacggtgagggacgaaagttaggggcgcgaaccggattagatacccgggtagtcctaactgtaaacgatgcggacttggtgttggggtggctttgagctgctccagtgccgaagggaagctgttaagtccgccgcctgggaagtacggtcgcaagactgaaacttaaaggaattggcgggggagcaccacaacgcgtggagcctgcggtttaattggattcaangccggacatctcaccagaggcgacagctgtatgatagccaggytgatgactttgcttgactagctgagaggaggtgcatggccgccgtcagctcgtaccgtgaggcgtcccgttaagtcaggcaacgagcgagacccacgcccttagttaccagcttatcccctcggggatgatgggcacactaaggggaccgcctatgataaataggaggaaggagtggacgacggtaggtccgtatgccccgaatcctctgggnaacacgcgggctacaatggctgagacaatgggttccgacaccgaaaggtggaggtaatcctctaaacttagtcgtagttcggattgaggactgtaactcgttctcatgaagctggaatgcgtagtaatcgngtntcaccattgc

SEQ ID NO: 1220 - DNA, 1335 bp, Methanobrevibacter woesei
  modified_base (32)..(32): a, c, t, g, unknown or other
tgctactgctattgggattcgattaagccatncaagttgaacgaatttagattcgtggcgtacggctcagtaacacgtggataacctacccttaggactgggataactctgggaaactggggataataccggataggcaatttttcctgtaatggttttttgtttaaatgttttttttcgcctaaggatgggtctgcggcagattaggtagttggttaggtaatggcttaccaagccgttgatctgtacgggttgtgagagcaagagcccggagatggaacctgagacaaggttccaggccctacggggcgcagcaggcgcgaaacctccgcaatgtgagaaatcgcgacggggggatcccaagtgccattcttaacgggatggcttttcattagtgtaaagagcttttggaataagagctgggcaagaccgttgccaaccgccgcggtaacaccgtcagctctagtggtagcagtttttattgggcctaaagcgtccgtagccggtttattaagtctctggtgaaatcctgtagcttaactgtgggaattgctggagatactagtagacttgagatcgggagaggttagaggtactcccagggtagaggtgaaattctgtaatcctgggaggaccgcctgtggcgaaggcgtctagctggaacgattctgccggtgagggacgaaagctaggggcgcgaaccggattagatacccgggtagtcctagctgtaaacgatgcggacttggtgttgggatggctttgagctgctccagtgccgaagggaagctgttaagtccgccgcctgggaagtacggtcgcaagactgaaacttaaaggaattggcgggggagcaccacaacgcgtggagcctgcggtttaattggattcaacgccggacatctcaccagaggcgacagctgtatgatgaccagtttgatgagcttgtttgactagctgagaggaggtgcatggccgccgtcagctcgtaccgtgaggcgtcctgttaagtcaggcaacgagcgagacccacgcccttagttaccagcggattctagtgaatgccgggcacactagggggaccgcctgtgataaataggaggaaggagtggacgacggtaggtccgtatgccccgaatcctctgggcaacacgcgggctacaatggatgagacaatgggttccgacgccgaaaggtggaggtaatcctctaaacttattcgtagttcggattgaggactgtaactcgttctcatgaagctggaatgcgtagtaatcgcgtgtcataatcgcgcggtgaatacgtccctgctccttggacacaccgcccgtcacg

SEQ ID NO: 1221 - DNA, 1366 bp, Methanobrevibacter wolinii
  modified_base (27)..(27): a, c, t, g, unknown or other
agctactgctattgggattcgattaanccatacaagatgaacgaactttttggttcgtggcgtacggctcagtaacacgtggataacctacccttaggactgggataactccgggaaactggggataatactggataggcaatttttcctgtaatggttttttgtttaaatgttttttcgcctaaggatgggtctgcggcagattaggttgttggttgggtaatggcttaccaagcctataatctgtacgggttgtgagagcaagagcccggagatggaacctgagacaaggttccaggccctacggggcgcagcaggcgcgaaacctccgcaatgtgagaaatcgcgacggggggatcccaagtgctattcttaacggggtagcttttcttaagtgtaaagagcttttggaataagagctgggcaagaccggtgccagccgccgcggtaacaccggcagctctagtggtagctgtttttattgggcctgaagcgttcgtagccggtttgataagtctctggtgaaatcttgtagcttaactgtgggaattgctggagatactattaggcttgagatcgggagaggtcagaggtactcctggggtaggggtgaaatcctgtaatcctaggaggaccacctgtggcgaaggcgtctgactagaacgattctgacggtgaggaacgaaagctaggggcgcgaaccggattagatacccgggtagtcctagccgtaaactatgcggacttggtgtgagggtggctttgagccgtcctggtgccgaagggaagctgttaagtccgccgcctgggaagtacggtcgcaagactgaaacttaaaggaattgtcgggggagcaccacaacgcgtggagcctgcggtttaattggattcaacgccggagatctcaccagcggcgacagcagtatgattatcaggctgatgaccttatttgacaagctgagaggaggtgcatggccgccgtcatctcgtgccgtgaggcgtcctgttaagtcaggcaacgagcgagacccacgctcttagttaccagcatgttactttggtaatgatggggacactaaggggaccgccagtgataaattggaggaaggagtggacgacggtaggtccgtatgccccgaatccgctgggctacacgcgggctacaatggcagagacaatgggttccgacgctgaaaagcggtggtaatcttttaaactttgtcgtagttcggattgagggctgtaactcgtcctcatgaagctggaatgcgtagtaatcgcgtgtcataatcgcgcggtgaatacgtccctgctccttggacacaccgaccgtcacgccacccaaaaagggcttggttgaggcttt

SEQ ID NO: 1222 - DNA, 1261 bp, Methanosphaera stadtmanae
gctcagtaacacgtggataacttacccttaggaccgggataactttgggaaactgaagataatactggatattaggttatgcctggaatggtttacctttgaaatgtatttttcgcctaaggatagatctgcggctgattaggtcgttggtggggtaatggcccaccaagccgatgatcggtacgggttgtgagagcaagagcccggagatggaacctgagacaaggttccagaccctacggggtgcagcaggcgcgaaacctccgcaatgtacgcaagtgcgacggggggatcccaagtgttattcttaacagaataacttttcattagtgtaaaaagcttttagaataagagctgggcaagaccggtgccagccgccgcggtaacaccggcagctcaagtggtagctgtttttattgggcctaaagcgttcgtagccggtttgataagtctttggtgaaagcttgtagcttaactataagaattgctgaagatactgtcagacttgaagtcgggagaggttagaggtactaccggggtaggggtgaaatcctataatcctgggaggaccacctgtggcgaaggcgtctaactggaacgatcttgacggtgagtaacgaaagccaggggcgcgaaccggattagatacccgggtagtcctggccgtaaacgatgtggacttggtgttggaatggcctcgagttgttccggtgccgaagggaagctgttaagtccaccgcctgggaagtacggtcgcaagactgaaacttaaaggaattggcgggggagcaccacaacgcgtggagcctgcggtttaattggattcaacgccggacatctcaccaggagcgacagcagaatgataatcaggttgatgaccttatttgactagctgagaggaggtgcatggccgccgtcagctcgtactgtgaagcgtcctgttaagtcaggcaacgagcgagacccacgcccttagttaccaacacaatctctggattggtgggcacactagggggaccgccagtgataaactggaggaaggagtggacgacggtaggtccgtatgccccgaatctcctgggctacacgcgggctacaatggctatggcaatgggtttctgcactgaaaagtgatggtaatctcctaaacatagtcttagttcggattgagggctgtaactcgccctcatgaagctggaatgcgtagtaatcgcatgtcacaaccgtgcggtgaatacgtccctgctccttgcacacaccg

SEQ ID NO: 1223 - DNA, 1347 bp, Methylobacterium extorquens
ccttagagtttgatcctggctcagagcgaactcttgcggcaggcttaacacatgcaagtcgaacgggcttcttcggaagtcagtggcagacgggtgagtaacacgtgggaacgtgcccttcggttcggaataactcagggaaacttgagctaataccggatacgcccttttggggaaaggttgactgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttaccccgagagatcggggatcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagagggacgcgaaaccgcgaggttgagcaaatccccaaaagccgtctcagttcggattgcactctgcaactcgggtgcatgaaggcggaatcgctagtaatcgtggatcagcacgccacggtgaatacgttcccgggccttgcaaaaaccgcccgtc

SEQ ID NO: 1224 - DNA, 1335 bp, Methylobacterium podarium
tgagtttgatcatggctcagagcgaacgctggcggcaggcttaacacatgcaagtcgaacgagtggcagacgggtgagtaacacgtgggaacgtgcccttcggttcggaataactcagggaaacttgagctaataccggatacggaaagctgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccgtctgacgctgaggcgcgaaagcgtggggagcaaacaggattagataccctggtagtccacgccgtaaacgatgaatgccagccgttggtcggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgccatgcacaggtgctgcatggctgtcgtcagctcgtgtcgtgagatgttgggttaagtcccgcaacgagcgcaacccacgtccttagttgccatcatgggcactctagggagactgccggtgataagccggaggaaggtgtggatgacgtcaagtcctcatggcccttacgggatgggctacacacgtgctacaatggcggtcagagggaggcgaaggggcgacctggagcaaatcccggccgtctcagttcggatgcactctgcaactcgggtgcagaaggcggaatcgctagtaatcgtggatcagcacgccacggtgaatacgttcccgggccttgtacacaccgcccgtcacaccatgggagttggtcttacccgacggcgctcgccaggcaggcgaccacggtagggtcagcgactggggtgaagtcgtaacaaggtaaccgta

SEQ ID NO: 1225 - DNA, 1516 bp, Methylobacterium radiotolerans
agagtttgatcctggctcaggctggaacacctcctcagagtttgatcatggctcagagcgaacgctggcggcaggcttaacacatgcaagtcgagcgggcccttcggggtcagcggcggacgggtgagtaacgcgtgggaacgtgccttctggttcggaataaccctgggaaactagggctaataccggatacgccctttttggggaaaggtttactgccggaagatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcgaggaggcaggcgaccacggtagggtcagcgactggggtgaagtcgtaacaaggtagccgtaggggaacctgcggctggatcacctccttagag

SEQ ID NO: 1226 - DNA, 1334 bp, Methylobacterium sp.
  1sub
gagtttgatcctggctcagagcgaacgctggcggcaggcttaacacatgcaagtcgaacgagtggcagacgggtgagtaacacgtgggaacgtgcccttcggttcggaataactcagggaaacttgagctaataccggatacggaaagctgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaaggggacagcggaactgcgagtgtagaggtgaaattcgtagatattcgcaagaacaccagtggcgaaggcggctgtctggtccgtctgacgctgaggcgcgaaagcgtggggagcaaacgggattagataccctggtagtccacgccgtaaacgatgaatgccagccgctggccggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatgcacaggtgctgcatggctgtcgtcagctcgtgtcgtgagatgttgggttaagtcccgcaacgagcgcaacccacgtccttagttgccatcatgggcactctagggagactgccggtgataagccggaggaaggtgtggatgacgtcaagtcctcatggcccttacgggatgggctacacacgtgctacaatggcggtcagtgggacgcgaaaccgcgaggttgagcaaatccccgccgtctcagttcggatgcactctgcaactcgggtgcagaaggcggaatcgctagtaatcgtggatcagcacgccacggtgaatacgttcccgggccttgtacacaccgcccgtcacaccatgggagttggtcttacccgacggcgctcgccaggcaggcgaccacggtagggtcagcgactggggtgaagtcgtaacaaggtaaccgta

SEQ ID NO: 1227 - DNA, 1334 bp, Methylobacterium sp.
  MM4
gagtttgatcatggctcagagcgaacgctggcggcaggcttaacacatgcaagtcgaacgagtggcagacgggtgagtaacacgtgggaacgtgcccttcggttcggaataactcagggaaacttgagctaataccggatacggaaagctgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccgtctgacgctgaggcgcgaaagcgtggggagcaaacaggattagataccctggtagtccacgccgtaaacgatgaatgccagccgttggccggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatgcacaggtgctgcatggctgtcgtcagctcgtgtcgtgagatgttgggttaagtcccgcaacgagcgcaacccacgtccttagttgccatcatgggcactctagggagactgccggtgataagccggaggaaggtgtggatgacgtcaagtcctcatggcccttacgggatgggctacacacgtgctacaatggcggtcagtgggacgcgaaaccgcgaggttgagcgaatccccgccgtctcagttcggatgcactctgcaactcgggtgcagaaggcggaatcgctagtaatcgtggatcagcacgccacggtgaatacgttcccgggccttgtacacaccgcccgtcacaccatgggagttggtcttacccgacggcgctcgccaggcaggcgaccacggtagggtcagcgactggggtgaagtcgtaacaaggtaaccgta

SEQ ID NO: 1228 - DNA, 1475 bp, Methylocella silvestris
agagtttgatcctggctcagaacgaacgctggcggcaggcctaacacatgcaagtcgaacgctgtagcaatacagagtggcagacgggtgagtaacacgtgggaacatacccttcggttcggaacaactcagggaaacttgagctaataccggatacgccctttgggggaaagatttatcgccgaaggattggcccgcgtctgattagctagttggcggggtaatggcccaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttacctgggaagataatgacggtaccaggagaataagccccggctaacttcgtgccagcagccgcggtaatacgaagggggctagcgttgttcggatttactgggcgtaaagcgcacgtaggcggatctttaagtcaggggtgaaatcccggggctcaacctcggaactgcctttgatactggggatctcgagtccgggagaggtgagcggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaacgatggatgctagccgttaggcagcttgctgcttagtggcgcagttaacgctttaagcatcccgcctggggagtacggtcgcaagattaaaactcaaaggaattgacgggggcccgcacaagcggtggagcatgtggtttaattcgaagcaacgcgcagaaccttaccagctcttgacatgtccggtttggtttccagagatggattccttcagttaggctggccggaacacaggtgctgcatggctgtcgtcagctcgtgtcgtgagatgttgggttaagtcccgcaacgagcgcaaccctcgcccttagttgccatcatttagttgggcactctagggggactgccggtgataagccgagaggaaggtggggatgacgtcaagtcctcatggcccttacgggctgggctacacacgtgctacaatggcggtgacagtgggatgctaaggggcgacccctcgcaaatctcaaaaagccgtctcagttcggattgcgctctgcaactcgagcgcatgaaggtggaatcgctagtaatcgtagatcagaacgctacggtgaatacgttcccgggccttgtacacaccgcccgtcacaccatgggagttggttctacccgaaggcgttttcttaaccgcaaggagagaggcgaccacggtagggtcagcgactggggtgaagtcgtaacaaggtagccgtaggggaacctgcggctggatcacct

SEQ ID NO: 1229 - DNA, 1351 bp, Methylophilus sp.
  ECd5
  modified_base (77)..(77): a, c, t, g, unknown or other
  modified_base (1012)..(1012): a, c, t, g, unknown or other
tggcggaatgctttacacatgcaagtcgaacggcagcacgggagcttgctcctggtggcgagtggcgaacgggtgantaatatatcggaacgtatccaataatgggggataactaatcgaaaggttggctaataccgcatacgccctacgggggaaagctagggaccttcgggcctggcgttaatggagcggccgatatctgattagctagttggtgaggtaaaagctcaccaaggcgacgatcagtagctggtctgagaggacgaccagccacactggaactgagacacggtccagactcctacgggaggcagcagtggggaattttggacaatgggcgcaagcctgatccagccattccgcgtgagtgaagaaggccttcgggttgtaaagctctttcgcaagggaagaaagattatcctctaacataggatgattatgacggtaccttgataagaagcaccggctaactacgtgccagcagccgcggtaatacgtagggtgcgagcgttaatcggaattactgggcgtaaagcgtgcgcaggctgttttgtaagtcagatgtgaaatccctgagctcaacttaggaactgcgtttgaaactacaagactagaatatgtcagaggggggtagaattccacgtgtagcagtgaaatgcgtagagatgtggaggaataccaatggcgaaggcagccccctgggataatattgacgctcatgcacgaaagcgtggggagcaaccaggattagatacctggtagtccacgccctaaacgatgtttactagttgttggtggagtaaaatccatgagtaacgcagctaacgcgtgaagtagaccgcctggggagtacggtcgcaagattaaaactcaaaggaattgacgggggcccgcacaagcggtggattatgtggattaattcgatgcaacgcgaaaaaccttacctggccttgacatgccactaacgaagcagagatgcattaggtgctcgaaagagaaagtggacacaggngctgcatggctgtcgtcagctcgtgtcgtgagatgttgggttaagtcccgcaacgagcgcaacccttgccaataattgccatcatttagttgggcactttattgggactgccggtgacaaaccggaggaaggtggggatgacgtcaagtcctcatggcccttatggccagggcttcacacgtaatacaatggtcggtacagagagttgccaacccgcgagggggagccaatctcagaaagccgatcgtagtccggattgcaggctgcaactcgcctgcatgaagtcggaatcgctagtaatcgcggatcagcatgtcgcggtgaatacgttcccgggcc

SEQ ID NO: 1230 - DNA, 1472 bp, Microbacterium chocolatum
  modified_base (176)..(179): a, c, t, g, unknown or other
tgcttacaacatgcaagtcgaacggtgaagccaagattgcttggtggatcagtggcgaacgggtgagtaacacgtgagcakcctgccctgaactctgggataagcgctggaaacggcgtctaatactggatatgagctgcggaggcatcttcgtggttggaaagatttttcggttnnnnatgggctcgcggcctatcagcttgttggtgaggtaatggctcaccaaggcgtcgacgggtagccggcctgagagggtgaccggccacactgggactgagacacggcccagactctacgggaggcagcagtggggaatattgcacaatgggcggaagcttgatgcagcaacgccgcgtgagggatgacggcttcgggttgtaaacctcttttagcagggaagaagcgaaagtgacggtacctgcagaaaaagcgccggctaactacgtgccagcagccgcggtaatacgtagggcgcaaccgttatccggaattattgggcgtaaagagctcgtaggcggtttgtcgcgtctgctgtgaaatcccgaggctcaacctcgggtgtgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaagaggcttagataccctggtagtccaccccgtaaacgttgggaactagttgtggggtccattcctcggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacgctgcagaaatgtagaactctttggacactcgtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggtagacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcgctggatcacctcc

SEQ ID NO: 1231 - DNA, 1475 bp, Microbacterium flavescens
gatgaacgctggcggcgtgcttaacacatgcaagtcgaacggtgaagcagagcttgctctgtggatcagtggcgaacgggtgagtaacacgtgagcaacctgccccggactctgggataagcgctggaaacggcgtctaatactggatatgaatcgcgaccgcatggtcagtggttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggacgacggccttcgggttgtaaacctcttttagcaaggaagaagcgaaagtgacggtacttgcagaaaaagcgccggctaactacgtgccagcagccgcggtaatacgtagggcgcaagcgttatccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacgctgcagaaatgtagaactctttggacactcgtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaagg

SEQ ID NO: 1232 - DNA, 1317 bp, Microbacterium gubbeenense
  modified_base (71)..(71): a, c, t, g, unknown or other
  modified_base (98)..(98): a, c, t, g, unknown or other
  modified_base (132)..(132): a, c, t, g, unknown or other
  modified_base (188)..(188): a, c, t, g, unknown or other
  modified_base (197)..(197): a, c, t, g, unknown or other
acagttggaaacagctgctaataccggatacgcacgagaaccgcatggttactcgtgggaaagatttttcngttcgggaggggctcgcgtcctatcancttgttggtgaggtagtggctcaccaaggcgtcnacgggtagccggcctgagagggtgaccggccacactgggactgagacacggcccanactcctacnggaggcagcagtggggaatattgcacaatgggcgcaagcctgatgcagcaacgccgcgtgagggacgacggccttcgggttgtaaacctcttttagttgggaagaagccttcgggtgacggtaccttcagaaaaagcaccggctaactacgtgccagcagccgcggtaatacgtagggtgcaagcgttatccggaattattgggcgtaaagagctcgtaggcggtttgtcacgtctgctgtgaaaactggaggctcaacttccagcttgcagtgggtacgggcagacttgagtgcggtaggggagattggaattcctggtgtagcggtggaatgcgcagatatcaggaggaacaccgatggcgaaggcagatctctgggcccgtaactgacgctgaggagcgaaagagtggggagcaaacaggcttagataccctggtagtccactccgtaaacgttgggaactagttgtgggggcctttctacggtctccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatataccggaaacggcttggaaacagtcgcccccttgtggtcggtatacaggtggtgcatggttgtcgtcagctcgtgtcgtgagatgttgggttaaagtcccgcaacgagcgcaaccctcgttctatgttgccagcacgttatggtgggaactcatggaatactgccggggtcaactcggaggaaggtggggatgacgtcaaatcatcatgccccttatgtcttgggcttcacgcatgctacaatggccggtacaatgggctgcgataccgtgaggtggagcgaatcccaaaaagccggtcccagttcggattgtagtctgcaactcgactacatgaagtcggagtcgctagtaatcgcagatcagcaacgctgcggtgaatacgttcccgggtcttgtacacaccgcccgtcaagtcatgaaagtcggtaacacctgaagccggtggcctaaccccttgtgggagggagctgtcgaaggtggga

SEQ ID NO: 1233 - DNA, 1479 bp, Microbacterium lacticum
tttgcaaagcgtttgtggcgtgcttaacacatgcatatcgaacggtgaaggcggagcttgctctgctggatcagtggcgaacgggtgagtaacacgtgagcaatctgcccctgactctgggataagcgctggaaacggcgtctaatactggatacgagctgcgaaggcatcttcagcagctggaaagaayttcggtcagggatgagctcgcggcctatcagcttgttggtgaggtaacggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaaccccgaggctcaacctcgggcctgcagtgggtacgggcagactagagtgcggtagrggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtcatggtgggaactcatggaatactgccggggtcaactcggaggaaggtgaggatgacgtcaaatcatcatgccccttatgtcttgggcttcacgcatgctacaatggccggtacaatgggctgcaataccgcaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaagg

SEQ ID NO: 1234 - DNA, 1475 bp, Microbacterium oleivorans
gatgaacgctggcggcgtgcttaacacatgcaagtcgaacggtgaagcagagcttgctctgtggatcagtggcgaacgggtgagtaacacgtgagcaacctgcccctgactctgggataagcgctggaaacggcgtctaatactggatatgagctgcgaccgcatggtcagcagttggaaagatttttcggtctgggatgggctcacggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgttactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggattggtaattaggactaagtcgtaacaaggtagccgtaccggaagg

SEQ ID NO: 1235 - DNA, 1467 bp, Microbacterium oxydans
tggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatatgtgacgtgaccgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaagg

SEQ ID NO: 1236 - DNA, 1490 bp, Microbacterium paraoxydans
tagagtttgatcctggctcaggatgaacgctggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatatgtgacgtgaccgcatggtctgcgtttggaaagatttttcggttggggaggggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagctgtcgaaggtgggatcggtaattaggactaagtcgtaacaaggtagccgta

SEQ ID NO: 1237 - DNA, 1474 bp, Microbacterium phyllosphaerae
gctgaacgctggcggcgtgcttaacacatgcaagtcgaacggtgaagcccagcttgctgggtggatcagtggcgaacgggtgagtaacacgtgagcaatctgcccctgactctgggataagcgctggaaacggcgtctaatactggatacgaacagcgaccgcatggtcagttgttggaaagaatttcggtcagggatgagctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaagg

SEQ ID NO: 1238 - DNA, 1460 bp, Microbacterium schleiferi
tggcggcgtgcttaacacatgcaagtcgaacggtgaagcagagcttgctctgtggatcagtggcgaacgggtgagtaacacgtgagcaatctgcccctgactctgggataagcgctggaaacggcgtctaataccggatacgagctgcgaaggcatcttcagcagctggaaagaatttcggtcagggatgagctcgcggcctatcagcttgttggtgaggtaacggctcaccaagccgtcgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcaggaaagaagcgaaagtgacggtacctgcagaaaaagcgccggctaactacgtgccagcagccgcggtaatacgtagggcgcaagcgttatccggaattattgggcgtaaagagctcgtaggcggtctgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccg

SEQ ID NO: 1239 - DNA, 1475 bp, Microbacterium sp.
  768
gatgaacgctggcggcgtgcttaacacatgcaagtcgaacggtgaagcccagcttgctgggtggatcagtggcgaacgggtgagtaacacgtgagcaacctgcccctgactctgggataagcgctggaaacggcgtctaatactggatacgaaccacagtcgcatggctcgtggttggaaagattttttggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcaaggaagaagcgaaagtgacggtacttgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtcctttccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacaccctagaaataggggactctttggacactcgtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaagg

SEQ ID NO: 1240 - DNA, 1474 bp, Microbacterium sp.
  oral strain C24KA
aggatgaacgctggcggcgtgcttaacacatgcaagtcgaacggtgaaggcccagcttgctgggtggatcagtggcgaacgggtgagtaacacgtgagcaatctgcccctgactctgggataagcgctggaaacggcgtctaatactggatatgaaccgtggaggcatcttcaacggttggaaagattttttggtcagggatgagctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgctgcagaaatgtagaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccgg

SEQ ID NO: 1241 - DNA, 1474 bp, Microbacterium testaceum
gatgaacgctggcggcgtgcttaacacatgcaagtcgaacggtgaagccaagcttgcttggtggatcagtggcgaacgggtgagtaacacgtgagcaacctgccctggactctgggataagcgctggaaacggcgtctaatactggatatgagctcctatcgcatggtgggggttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgagagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaagg

SEQ ID NO: 1242 - DNA, 1497 bp, Micrococcus antarcticus
tcagaacgaacgctggcggcgtgcttaacacatgcaagtcgaacgatgaagcccagcttgctgggtggattagtggcgaacgggtgagtaacacgtgagtaacctgcccttgactctaggataagcccgggaaactgggtctaatactggataggaacgtctaccgcatggtgggtgttggaaagaatttcggtcatggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaacattccacgttttccgcgccgcagctaacgtattaggtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacggtttcccctttggggcgggttcacaggtggtgcatggttgtcgtcagctcgtgtcgtgagatgttgggttaagtcccgcaacgagcgcaaccctcgttccatgttgccagcacttcgggtggggactcatgggagactgccggggtcgactcggaggaaggtggggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcctaacccttgtggagggggccgtcgaaggtgggaccagcgattgggactaagtcgtaacaaggtagccgtaccggaaggtgcggctggatcacctcctt

SEQ ID NO: 1243 - DNA, 1632 bp, Micrococcus luteus
ttacggagagtttgatcctggctcaggatgaacgctggcggcgtgcttaacacatgcaagtcgaacgatgaagcccagcttgctgggtggattagtggcgaacgggtgagtaacacgtgagtaacctgcccttaactctgggataagcctgggaaactgggtctaataccggataggagcgtccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttcccgatcgccgtagagatacgatttcccctttggggcgggttcacaggtggtgcatggttgtcgtcagctcgtgtcgtgagatgttgggttaagtcccgcaacgagcgcaaccctcgttccatgttgccagcacgtaatggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcctaacccttgtgggagggagccgtcgaaggtgggaccagcgattgggactaagtcgtaacaaggtagccgtaccggaaggtgcggctggatcacctcctttctaaggagcatcagtgcccgttgcatcaccgcgtgtgtgatggcgggttgctcatgggtggaacatcaatgaatggtgccagtggtggtgccggcagtgctcgagtacg

SEQ ID NO: 1244 - DNA, 1472 bp, Micrococcus lylae
gatcctggctcaggatgaacgctggcggcgtgcttaacacatgcaagtcgaacgatgaagctccagcttgctggggtggattagtggcgaacgggtgagtaacacgtgagtaacctgcccttgactctgggataagccttggaaacggggtctaataccggataggagcattcaccgcatggtgggtgttggaaagaatttcggtcttggatggactcgcggcccatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgccgtgaaagtccggggcttaactccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgtttggcactaggtgtgggggccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgttcgccgtagagatacggtttcccctttggggcgggttcacaggtggtgcatggttgtcgtcagctcgtgtcgtgagatgttgggttaagtcccgcaacgagcgcaacccctgttctatgttgccagcacgtgatggtggggactcatgggagactgccggggtcaactcggaggaaggtggggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagttggagtcgctagtaatcgcagatcagcaacgctgcggtgaatacgttcccgggccttgtacacaccgcccgtcaagtcacgaaagtcggtaacacccgaagccggtggcctaacccttgtggaaggagccgtcgaaggtgggactggcgattgggactaagtcgtaacaag

SEQ ID NO: 1245 - DNA, 1469 bp, Micrococcus sp.
  185
  modified_base (977)..(977): a, c, t, g, unknown or other
cgctggcggcgtgcttaacacatgcaagtcgaacgatgaagcccagcttgctgggtggattagtggcgaacgggtgagtaacacgtgagtaacctgcccttaactctgggataagcctgggaaactaggtctaataccggataggagcgcctaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacggtttccccttnggggcgggttcacaggtggtgcatggttgtcgtcagctcgtgtcgtgagatgttgggttaagtcccgcaacgagcgcaaccctcgttccatgttgccagcacgtaatggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggaccagcgattgggactaagtcgtaacaaggtagccgtaccggaagg

SEQ ID NO: 1246 - DNA, 1502 bp, Microcystis aeruginosa
ttcatcatggagagtttgatcctggctcaggatgaacgctggcggcgtgcctaacacatgcaagtcgaacgggaatcttcggattctagtggcggacgggtgagtaacgcgtaagaatctaacttcaggacggggacaacagttggaaacgactgctaatacccgatatgccgcgaggtgaaacctaattggcctgaagaagagcttgcgtctgattagctagttggtggggtaagagcctaccaaggcgacgatcagtagctggtctgagaggatgagcagccacactgggactgagacacggcccagactcctacgggaggcagcagtggggaattttccgcaatgggcgaaagcctgacggagcaacgccgcgtgagggaggaaggtctttggattgtaaacctcttttctcaaggaagaagttctgacggtacttgaggaatcagcctcggctaactccgtgccagcagccgcggtaatacgggggaggcaagcgttatccggaattattgggcgtaaagcgtccgcaggtggtcagccaagtctgctgtcaaatcaggttgcttaacgacctaaaggcggtggaaactggcagactagagagcagtaggggtagcaggaattcccagtgtagcggtgaaatgcgtagagattgggaagaacatcggtggcgaaagcgtgctactgggctgtatctgacactcagggacgaaagctaggggagcgaaagggattagatacccctgtagtcctagccgtaaacgatggatactaggcgtggcttgtatcgacccgagccgtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaaccctggtgaaagctgggggtgccttcgggagcgcgaacacaggtggtgcatggctgtcgtcagctcgtgtcgtgagatgttgggttaagtcccgcaacgagcgcaaccctcgttcttagttgccagcattaagttggggactctaaggagactgccggtgacaaaccggaggaaggtggggatgacgtcaagtcagcatgccccttacgtcttgggcgacacacgtactacaatggtcgggacaaagggcagcgaactcgcgagagccagcgaatcccagcaaacccggcctcagttcagattgcaggctgcaactcgcctgcatgaaggaggaatcgctagtaatcgccggtcagcatacggcggtgaattcgttcccgggccttgtacacaccgcccgtcacaccatggaagctggtcacgcccgaagtcattacctcaaccgcaaggagggggatgcctaaggcagggctagtgactggggtgaagtcgtaacaaggtagccgtaccggaaggtgtggctggatcacctccttaaagggagacc

SEQ ID NO: 1247 - DNA, 1543 bp, Mitsuokella jalaludinii
tgatcctggctcaggacgaacgctggcggcgtgcttaacacatgcaagtcgtacgagacgattgaaagcttgcttttgaaagtcgagtggcaaacgggtgagtaacgcgtagacaacctgccgtaaagatggggacaacagttcgaaaggactgctaataccgaatgttgtagagtttccgcatgggaatcctactaaaggtggcctctacttgtaagctatcgctttacgatgggtctgcgtctgattagctagttggtggggtaacggcctaccaaggcgacgatcagtagccggtctgagaggatgaacggccacattggaactgagacacggtccagactcctacgggaggcagcagtggggaatcttccgcaatgggcgcaagcctgacggagcaacgccgcgtgagtgaagaagggtttcgactcgtaaagctctgttgtcggggacgaatgtggagatggtgaataaccatttccaatgacggtacctgacgaggaagccacggctaactacgtgccagcagccgcggtaatacgtaggtggcgagcgttgtccggaattattgggcgtaaagggagcgcaggcgggaaggtaagtctatcttaaaagtgcggggctcaaccccgtgaggggatggaaactatctttcttgagtgcaggagaggaaagcggaattcctagtgtagcggtgaaatgcgtagatattaggaggaacaccagtggcgaaggcggctttctggactgtaactgacgctgaggctcgaaagcgtggggagcgaacaggattagataccctggtagtccacgccgtaaacgatgaatgctaggtgtaggaggtatcgacccctcctgtgccggagttaacgcaataagcattccgcctggggagtacggccgcaaggctgaaactcaaaggaattgacgggggcccgcacaagcggtggagtatgtggtttaattcgacgcaacgcgaagaaccttaccagggcttgacattgagtgaaagggctagagatagttccctctcttcggagacacgaaaacaggtggtgcatggctgtcgtcagctcgtgtcgtgagatgttgggttaagtcccgcaacgagcgcaacccctatcctttgttgccagcacgcaatggtgggaactcaaaggagactgccgcggacaacgcggaggaaggcggggatgacgtcaagtcatcatgccccttatgtcctgggctacacacgtactacaatgggatggacagagagcagcgaagccgcgaggccaagcgaaccccataaaccatctcccagttcggattgcaggctgcaacccgcctgcatgaagttggaatcgctagtaatcgcaggtcagcatactgcggtgaatacgttcccgggccttgtacacaccgcccgtcacaccacggaagtcattcacacccgaagccggcaggctaaccgcaaggaggcagccgtctaaggtgggggcgatgactggggtgaagtcgtaacaaggtagccgtatcggaaggtgcggctggatcactc

SEQ ID NO: 1248 - DNA, 1559 bp, Mitsuokella multacida
tggagagtttgatcctggctcaggacgaacgctggcggcgtgcttaacacatgcaagtcgaacgagacgattgaaagcttgcttttgaaagtcgagtggcaaacgggtgagtaacgcgtagacaacctgccgtaaagatggggacaacagtccgaaaggactgctaataccgaatgttgtggaacttccgcatgggagctctactaaagatggcctctacttgtaagctatcgctttacgatgggtctgcgtctgattagctagttggtggggtaatggcttaccaaggcgacgatcagtagccggtctgagaggatgaacggccacattggaactgagacacggtccagactcctacgggaggcagcagtggggaatcttccgcaatgggcgcaagcctgacggagcaacgccgcgtgagtgaagaagggtttcgactcgtaaagctctgttgtcggggacgaatgtggagatggtgaataaccatttccaatgacggtacctgacgaggaagccacggctaactacgtgccagcagccgcggtaatacgtaggtggcgagcgttgtccggaattattgggcgtaaagggagcgcaggcgggagatcaagtctatcttaaaagtgcggggctcaaccccgtgaggggatggaaactggtcttcttgagtgcaggagaggaaagcggaattcctagtgtagcggtgaaatgcgtagatattaggaggaacaccagtggcgaaggcggctttctggactgtaactgacgctgaggctcgaaagcgtggggagcgaacaggattagataccctggtagtccacgccgtaaacgatgaatgctaggtgtaggaggtatcgacccctcctgtgccggagttaacgcaataagcattccgcctggggagtacggccgcaaggctgaaactcaaaggaattgacgggggcccgcacaagcggtggagtatgtggtttaattcgacgcaacgcgaagaaccttaccagggcttgacattgagtgaaagagctagagatagctccctctcttcggagacacgaaaacaggtggtgcatggctgtcgtcagctcgtgtcgtgagatgttgggttaagtcccgcaacgagcgcaacccctatcctttgttgccagcacgtaatggtgggaactcaaaggagactgccgcggacaacgcggaggaaggcggggatgacgtcaagtcatcatgccccttatgtcctgggctacacacgtactacaatgggatggacagagagcagcgaagccgcgaggccaagcgaaccccataaaccatctcccagttcggattgcaggctgcaacccgcctgcatgaagttggaatcgctagtaatcgcaggtcagcatactgcggtgaatacgttcccgggccttgtacacaccgcccgtcacaccacggaagtcattcacacccgaagccggcaggctaaccgcaaggaggcagccgtctaaggtgggggcgatgactggggtgaagtcgtaacaaggtagccgtatcggaaggtgcggctggatcacctcctttct

SEQ ID NO: 1249 - DNA, 1224 bp, Mitsuokella sp.
  oral taxon 521
gacgaacgctggcggcgtgcttaacacatgcaagtcgaacgagacaattaaaagcttgcttttaaacgtcgagtggcaaacgggtgagtaacgcgtagacaacctgccgcaaagatggggacaacagttcgaaaggactgctaataccgaatgttctggaagttccgcatggaaactccagcaaagatggcctctacttgtaagcgatcgctttgcgatgggtctgcgtctgattagctagttggcagggcaacggcctaccaaggcgacgatcagtagccggtctgagaggatgaacggccacattgggactgagacacggcccagactcctacgggaggcagcagtggggaatcttccgcaatgggcgaaagcctgacggagcaacgccgcgtgagtgaagaaggtcttcggatcgtaaagctctgttgccggggacgacatgtaggcagtgcgaacagcattgtgtaatgacggtacccggcgaggaagccacggctaactacgtgccagcagccgcggtaatacgtaggtggcgagcgttgtccggaattattgggcgtaaagggagcgcaggcgggcgagtaagtctttcttaaaagtgcggggctcaaccccgtgaggggagagaaactactcatcttgagtgcaggagaggaaagcggaattcctagtgtagcggtgaaatgcgtagatattaggaagaacaccagtggcgaaggcggctttctggactgtaactgacgctgaggctcgaaagccaggggagcgaacgggattagataccccggtagtcctggccgtaaacgatgaatgctaggtgtagggggtatcgacccctcctgtgccggagttaacgcaataagcattccgcctggggagtacggtcgcaagactgaaactcaaaggaattgacgggggcccgcacaagcggtggagtatgtggtttaattcgacgccacgcgatgaaccttaccagggcttgacattgagtgacagacttagagacaagtcattctcttcggagacacgaaaactggtggtgcatggctgtcgtcagctcgtgtcgtgagatgtagggttagttccgcacgagcgcaccccctattctctgttgccagcacgcgaaggtgggaactcaaaggaaactgccgccgaaccagccggagaaaggcggggaatacgtcagttatcatgccccctagttcgtggctacaccgttca

SEQ ID NO: 1250 - DNA, 1210 bp, Mitsuokella sp.
  oral taxon G68
gacgaacgctggcggcgtgcttcaacacatgcaagtcgaacgagacaattaaaagcttgcttttcaaacgtccgagtggcaaacgggtgagtcaacgcgtagacaacctgccgcaaagatggggacaacagttccgaaaggactgctaataccgaatgttcctggaagttcccgcatggaaactcccagcaaagatggcctcctacttgtaagcgatccgctttgcgatgggtcctgcgtcctgattagctagttggtgaggtaacggcctaccaaggcgacgatcagtagccggtcctgagaggatgaacggccacattgggactgagacacggcccagactccctacgggaggcagcagtggggaatccttccgcaatgggcgaaagcctgacggagcaacgccgcgtgagtgaagaaggtccttcggatccgtaaagctctgttgccggggacgagtgtaggcaatgcaaacagcattgtgtaatgacggtacccggcgaggaagccacggctaactacgtgccagcagccgcggtaatacgtaggtggcgagcgttgtccggaattattgggcgtaaagggagcgcaggcgggcgagtaagtctttcttaaaagtgcggggctcaaccccgtgaggggagagaaactactcatcttgagtgcaggagaggaaggcggaattcctagtgtagcggtgaaatgcgtagatattaggaagaacaccagtggcgaaggcggctttctggactgtaactgacgctgaggctcgaaagccaggggagcgaacgggattagataccccggtagtcctggccgtaaacgatgaatgctaggtgtagggggtatcgacccctcctgtgccggagttaacgcaataagcattccgcctggggagtacggtagcaagactgaaactcaaaggaattgacgggggcccgcacaagcggtggagtatgtggtttaattcgacgcaacgcgaagaacttaccaggtcttgacatagagtgacagacttagagacaagtcattctcttcggagacacgagaacagggtggtgcatggctgtcgtcagctcgtgtcgtgagatgtttgggttagttccgccacgagcgcacgcctattctctgttgccagcactgcgatggtgggaactcgaggagacgcgccgacacgccgaggaggcgggatagttagtagcatccctag

SEQ ID NO: 1251 - DNA, 1544 bp, Mobiluncus curtisii
tttttttggagagtttgatcctggctcaggacgaacgctggcggcgtgcttaacacatgcaagtcgaacgatgaagccgcagcttgctgtggtggattagtggcgaacgggcgagtaacacgtgagtaacctgtccttttctttgggataacggctggaaacggctgctaatactggatattcaggcgtcaccgcatggtggtgtttggaaaggttttttctgggattgggtgggctcgcggcctatcagcttgttggtggggtgatggcttaccaaggctttgacgggtagccggcctgagagggtggtcggtcgcactgggactgagatacggcccagactcctacgggaggcagcagtggggaatattgcacaatggacgaaagtttgatgcagcgacgccgcgtggagggtgtaggccttcgggttgtgaactcctttttctcgcgaaaaaggcacagttttggctgtgttgatggtagtgggggaagaagcgccggctaactacgtgccagcagccgcggtaatacgtagggcgcgagcgttgtccggatttattgggcgtaaagagctcgtaggtggttcgtcgcgtctgtcgtgaaagccagcagcttaactgttggtctgcggtgggtacgggcgggcttgagtgcggtaggggtgactggaattcctggtgtagcggtggaatgcgcagatatcaggaggaacaccgatggcgaaggcaggtcactgggccgttactgacactgaggagcgaaagcgtggggagcgaacaggattagataccctggtagtccacgctgtaaacgttgggaactaggtgtggggatgctatcctgtgtttctgcgccgtagctaacgcattaagttccccgcctggggagtacggtcgcaaggctaaaactcaaaggaattgacgggggcccgcacaagcggcggagcatgcggattaattcgatgcaacgcgaagaaccttaccaaggcttgacatacactgcgatggttccagagatgggccagccttcggggtggtgtacaggtggtgcatggttgtcgtcagctcgtgtcgtgagatgttgggttaagtcccgcaacgagcgcaacccttgcctcatgttgccagcggttcggccggggactcgtgagggactgccggggttaactcggaggagggtggggatgacgtcaaatcatcatgccccttatgtcttgggcttcacgcatgctacaatggccagtacagagggttgcgataccgtgaggtggggctaatctcttaaagctggtctcggttcggattggggtctgcaactcgaccccatgaagttggagtcgctagtaatcgcagatcagcattgctgcggtgaatacgttctcgggccttgtacacaccgcccgtcacgtcacgaaagttggtaacacccgaagcccgtggcttaactctttttgagggggagcggtcgaaggtgggattggcgattgggacgaagtcgtaacaaggtagccgtaccggaaggtgcggctggatcacctcctttct

SEQ ID NO: 1252 - DNA, 1542 bp, Mobiluncus mulieris
ttttgttggagagtttgatcctggctcaggacgaacgctggcggcgtgcttaacacatgcaagtcgaacgatgaagccgcagcttgctgtggtggattagtggcgaacgggcgagtaacacgtgagtaacctgtccttttctttgggataacggctggaaacggctgctaatactggatattcaggctgcatcgcatggtgtggtttggaaaggttttttctggaatggggtgggctcgcggcctatcagcttgttggtggggtgatggcttaccaaggctttgacgggtagccggcctgagagggtggtcggtcgcactgggactgagatacggcccagactcctacgggaggcagcagtggggaatattgcacaatggacggaagtttgatgcagcgacgccgcgtggagggtgtaggccttcgggttgtgaactcctttttctcgtgaaaaaggcatgcttttgggtgtgttgatggtagcgggggaagaagcgccggctaactacgtgccagcagccgcggtaatacgtagggcgcgagcgttgtccggatttattgggcgtaaagagctcgtaggtggttcgtcgcgtctgtcgtgaaagccagcagcttaactgttggtctgcggtgggtacgggcgggcttgagtgcggtaggggtgactggaattcctggtgtagcggtggaatgcgcagatatcaggaggaacaccgatggcgaaggcaggtcactgggccgttactgacgctgaggagcgaaagcgtggggagcgaacaggattagataccctggtagtccacgctgtaaacgttgggaactaggtgtggggatgctatcctgtgtttctgcgccgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatacactgcgacatgccagagatggtgtggccttcggggtggtgtacaggtggtgcatggttgtcgtcagctcgtgtcgtgagatgttgggttaagtcccgcaacgagcgcaacccttgcctcatgttgccagcacgttatggtggggactcgtgagggactgccggggttaactcggaggagggtggggatgacgtcaaatcatcatgccccttatgtcttgggcttcacgcatgctacaatggccagtacagagggttgcgataccgtgaggtggggctaatctcttaaagctggtctcggttcggattggggtctgcaactcgaccccatgaagttggagtcgctagtaatcgcagatcagcattgctgcggtgaatacgttctcgggccttgtacacaccgcccgtcacgtcacgaaagttggtaacacccgaagcccgtggcctagcctttttggggggagcggtcgaaggtgggattggcgattgggacgaagtcgtaacaaggtagccgtaccggaaggtgcggctggatcacctcctttct

SEQ ID NO: 1253 - DNA, 1532 bp, Moellerella wisconsensis
agagtttgatcatggctcagattgaacgctggcggcaggcctaacacatgcaagtcgagcggtaacaggaagaagcttgcttctttgctgacgagcggcggacgggtgagtaatgtatggggatctgcctgacagagggggataactactggaaacggtagctaataccgcataatctctaaggagcaaagcaggggaccttcgggccttgcgctgtcggatgaacccatatgggattagctagtaggtggggtaacggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagtcgggaggaaggcgttgatattaatactatcagcgattgacgttaccgacagaagaagcaccggctaactccgtgccagcagccgcggtaatacggggggtgcaagcgttaatcggaattactgggcgtaaagcgcacgcaggcggttgattaagttagatgtgaaatccccgggcttaacctgggaatggcatctaaaactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgttcccttgaggagtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaagggagactgccggtgataaaccggaggaaggtggggatgacgtcaagtcatcatggcccttacgagtagggctacacacgtgctacaatggcgcatacaaagagaagcgaactcgcgagagccagcggaactcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacctgcggttggatcacctt

SEQ ID NO: 1254 - DNA, 1455 bp, Mogibacterium diversum
  modified_base (792)..(793): a, c, t, g, unknown or other
acgctggcggcgtgcctaatacatgcaagtcgagcgagatgttagcgcatgaaccttcgggggattatgctaacggacagcggcggacggtgtgagtaacgcgtaggcaacctgcccctgacagagggatagccattggaaacgatgattaaaaccatcatgacaccgtagaagcacatgcttcatcggtcaaagatttatcggtcagggatgggcctgcgtctgattaactagttggtgaggtaacggctcaccaaggtgacgatcagtagccgacctgagagggtgatcggccacattggaactgagacacggtccaaacttctacggaaggcagcagtagggaatcttgcacaatgggcgaaagcctgatgcagcaacgccgcgtgaaggatgaaggccttcgggttgtaaacttctgttctaagggaagaaacaaatgacggtaccttaggagcaagccccggctaactacgtgccagcagccgcggtaatacgtagggggcaagcgttatccggaattattgggcgtaaagagtgcgtaggtggttacctaagcgcaaggtttaatttagaggctcaacctctacttgccttgcgaactgggctactttagtgcaggaggggaaagcggaattcctagtgtagcggtgaaatgcgtagatattaggaggaacaccagcggctgaaggtcggtctttctggactgtaactgacactgaggcacgaaagcgtgggtagcaaacaggattagataccctggtagtccacgccgtaaacgatgagcactanntgttgggcccgttagggctcagtgccgcagttaacgcaataagtgctccgcctggggagtacgctcgcaagagtaaaactcaaaggaattgacggggacccgcacaagcagcggagcatgtggtttaattcgaagcaacgcgaagaaccttaccagggcttgacatcctgctgacaggaccttaaccggtcccttcttcggacagcagagacaggtggtgcatggttgtcgtcagctcgtgtcgtgagatgttgggttaagtcccgcaacgagcgcaacccttgtcgctagttactaacattcagttgaggactctagcgagactgccgaggtcaactcggaggaaggtggggatgacgtcaaatcatcatgccccttatgttctgggctacacacgtgctacaatggtcggtacaatgagaggcaatactgtgaagtggagcaaatcaccaaaaccgatcccagttcggattgtaggctgcaactcgcctacatgaagttggagttgctagtaatcgcagatcagaatgctgcggtgaatgcgttcccgggtcttgtacacaccgcccgtcacaccatggaagttgggggtgcccaaagtcgtttaattaatctatcgcctaaggcaaaaccaatgactggggtgaagtcgtaacaaggta

SEQ ID NO: 1255 - DNA, 1478 bp, Mogibacterium neglectum
agtttgatcatggctcaggatgaacgctggcggcgtgcctaatacatgcaagtcgagcgagatgttagcgcatgaaccttcgggggattatgctaacggaaagcggcggacgggtgagtaacgcgtaggcaacctgcccctgacagagggatagccattggaaacgatgattaaaacctcatgacaccgatgaagcacatgcttcatcggtcaaagatttatcggtcagggatgggcctgcgtctgattaactagttggtgaggtaacggctcaccaaggtgacgatcagtagccgacctgagagggtgatcggccacattggaactgagacacggtccaaacttctacggaaggcagcagtagggaatcttgcacaatgggcgaaagcctgatgcagcaacgccgcgtgaaggatgaaggccttcgggttgtaaacttctgttctaagggaagaaacaaatgacggtaccttaggagcaagccccggctaactacgtgccagcagccgcggtaatacgtagggggcaagcgttatccggaattattgggcgtaaagagtgcgtaggtggttacctaagcgcaaggtttaatttagaggctcaacctctacttgccttgcgaactgggctacttgagtgcaggaggggaaagcggaattcctagtgtagcggtgaaatgcgtagatattaggaggaacaccagcggcgaaggcggctttctggactgtaactgacactgaggcacgaaagcgtgggtagcaaacaggattagataccctggtagtccacgccgtaaacgatgagcactaggtgttgggcccgttaggctcagtgccgcagttaacgcaataagtgctccgcctggggagtacgctcgcaagagtaaaactcaaaggaattgacggggacccgcacaagcagcggagcatgtggtttaattcgaagcaacgcgaagaaccttaccagggcttgacatcctgctgacaggaccttaaccggtcccttcttcggacagcagagacaggtggtgcatggttgtcgtcagctcgtgtcgtgagatgttgggttaagtcccgcaacgagcgcaacccttgtcgctagttactaacattcagttgaggactctagcgagactgccgaggtcaactcggaggaaggtggggatgacgtcaaatcatcatgccccttatgttctgggctacacacgtgctacaatggtcggtacaatgggatgcaatactgtgaagtggagcaaatcaccaaaaccgatcccagttcggattgtaggctgcaactcgcctacatgaagttggagttgctagtaatcgcagatcagaatgctgcggtgaatgcgttcccgggtcttgtacacaccgcccgtcacaccatgggaagttgggggtgcccaaagtcggttaattaatctatcgcctaaggcaaaaccaatgactggggtgaagtcgtaacaaggtaaccgt

SEQ ID NO: 1256 - DNA, 1466 bp, Mogibacterium pumilum
  modified_base (946)..(947): a, c, t, g, unknown or other
ttgatcctggctcaggatgaacgctggcggcgtgcctaatacatgcaagtcgagcgagatgttagtgcatgaacttcgggggattatattaacggacagcggcggacgggtgagtaacgcgtaggcaacctgcccttgacagagggatagccattggaaacgatgattaaaacctcataacaccgtagaagcacatgcttcaacggtcaaagatttatcggtcagggatgggcctgcgtctgattaactagttggtgaggtaacggctcaccaaggtgacgatcagtagccgacctgagagggtgatcggccacattggaactgagacacggtccaaacttctacggaaggcagcagtagggaatcttgcacaatggcgaaagcctgatgcagcaacgccgcgtgaaggatgaaggcttcgggttgtaaacttctgttctaagggaagaaacaaatgacggtaccttaggagcaagccccggctaactacgtgccagcagccgcggtaatacgtagggggcaagcgttatccggaattattgggcgtaaagagtgcgtaggtggttacctaagcgcaaggtttaatttagaggctcaacctctacttgccttgcgaactgggctacttgagtgcaggaggggaaagcggaattcctagtgtagcggtgaaatgcgtagatattaggaggaacaccagcggcgaaggcggctttctggactgtaactgacactgaggcacgaaagcgtgggtagcaaacaggattagataccctggtagtccacgccgtaaacgatgagcactaggtgttgggtccgttaggctcagtgccgcagttaacgcaataagtgctccgcctggggagtacgctcgcaagagtaaaactcaaaggaattgacggggacccgcacaagcagcggacatgtggtttaattcgaagcaacgcgnnagaaccttaccagggcttgacatcctgctgacaggatcttaaccgatcccttcttcggacagcagagacaggtggtgcatggttgtcgtcagctcgtgtcgtgagatgttgggttaagtcccgcaacgagcgcaacccttgtcgctagttactaacattcagttgaggactctagcgagactgccgaggtcaactcggaggaaggtggggatgacgtcaaatcatcatgccccttatgttctgggctacacacgtgctacaatggtcggtacaatgagaggcaatactgcgaagtggagcgaatcaccaaaaccgatcccagttcggattgtaggctgcaactcgcctacatgaagttggagttgctagtaatcgcagatcagaatgctgcggtgaatgcgttcccgggtcttgtacacaccgcccgtcacaccatggaagttgggggtgcccgaagtcggctaattaatctgtcgcctaaggcaaaaccaatgactggggtgaagtcgtaacaaggta

SEQ ID NO: 1257 - DNA, 1480 bp, Mogibacterium timidum
agagtttgatcctggctcaggatgaacgctggcggcgtgcctaatacatgcaagtcgagcgagaagcttggaaatgacgcttcggttgaatttccaagcggacagcggcggacgggtgagtaacgcgtaggcaacctgcccctgtacagagggatagccattggaaacgatgattaaaacctcatgacaccgtagtagcacatgctacatcggtcaaagatttatcggtcagggatgggcctccgtctgattaactggttggtgaggtaacggctcaccaaggtgacgatcagtagccgacctgagagggtgatcggccacattggaactgagacacggtccaaacttctacggaaggcagcagtagggaatcttgcacaatgggcgtaagcctgatgcagcaacgccgcgtgaaggatgaaggcttcgggttgtaaacttctgttctaagggaagaaagaaatgacggtaccttaggagcaagccccggctaactacgtgccagcagccgcggtaatacgtagggggcaagcgttatccggaattattgggcgtaaagagtgcgtaggtggttacctaagcgcaaggtttaaattagaggctcaacctctacatgccttgcgaactgggctacttgagtgcaggaggggaaagcggaattcctagtgtagcggtgaaatgcgtagatattaggaggaacaccggcggcgaaggcggctttctggactgtaactgacactgaggcacgaaagcgtgggtagcaaacaggattagataccctggtagtccacgccgtaaacgatgagcactaggtgttgggtccgttaggactcagtgccgcagttaacgcaataagtgtccgcctgggagtacgctcgcaagagtaaactcaaggaattgacgggcacccgcacaagcaggggagcttgtggtttaattcgaagcaacgcgaagaaccttaccagggcttgacatcctgctgacagaaccttaatcggttttttcttcggacagcagagacaggtggtgcatggttgtcgtcagctcgtgtcgtgagatgttgggttaagtcccgcaacgagcgcaacccttgtcgctagttactaacattcagttgaggactctagcgagactgccgaggtcaactcggaggaaggtggggatgacgtcaaatcatcatgccccttatgttctgggctacacacgtgctacaatggtcggtacaatgagatgcaatactgcgaagtggagcgaaacaccaaaaccgatcccagttcggattgtaggctgcaactcgcctacatgaagtcggagttgctagtaatcgcagatcagaatgctgcggtgaatgcgttcccgggtcttgtacacaccgcccgtcacaccatggaagttgggggtgcccaaagtcggttaattaatctatcgcctaaggcaaaaccaatgactggggtgaagtcgtaacaaggtacccgtagga

SEQ ID NO: 1258 - DNA, 1400 bp, Mollicutes bacterium pACH93
gcaagtcgaacgaagaactagcttgctagttcttagtggcgaacgggtgagtaatacataaataatctgtccatatgactgggataactattggaaacgatagctaataccggataggttaattgaaggcatcttcgattaattaaagtaggttttctacacaaatggatgagtttatggcgcattagttagttggtggggtaacggcctaccaagacgatgatgcgtagccgacctgagagggtgaccggccacactgggactgagacacggcccagactcctacgggaggcagcagtagggaattttcggcaatgggcgcaagcctgaccgagcaacgccgcgtgagtgattaaggccttcgggttgtaaagctctgttgtaagggaagaaaaatcagtagaggaaatgatactgatcagacggtaccttaccagaaagccacggctaactacgtgccagcagccgcggtaatacgtaggtggcaagcgttatccggaattattgggcgtaaagggtgcgtaggcggtttattaagtctatggtgaaagtgcggggctcaaccccgtatggccatagaaactgatagactagagtgcaggagagggcaatggaattccatgtgtagcggtaaaatgcgtagatatatggaggaacaccagtggcgaaggcggttgcctggcctgtaactgacgctgaagcacgaaagcgtggggagcaaataggattagataccctagtagtccacgccgtaaacgatgaatactaagtgttggagaaattcagtgctgcagttaacgcaataagtattccgcctggggagtatgcacgcaagtgtgaaactcaaaggaattgacgggaccccgcacaagcggtggattatgttgtttaattcgacgcaacgcgaagaaccttaccaggccttgacatactcagcaaaaccctagagatagggtggaggttatctgggatacaggtggtgcatggttgtcgtcagctcgtgtcgtgagacgttgggttaagtcccgcaacgagcgcaacccttgtctttagttaccatcattcagttggggactctagagagactgccggtgataaaccggaggaaggtggggatgacgtcaaatcatcatgccccttatggcctgggctacaaacgtaatacaatggcgtatacaaagggatgcgaaagggtgacctggagcaaaactcacaaagtacgtctcagttcagattggagtctgcaactcgactccatgaaggcggaatcgctagtaatcgcggatcagcatgccgcggtgaatacgttctcggggtttgtacacaccgcccgtcaaaccatgagagttggtaatacccgaagccggtggcctaacctagtaataggagggagccgtcga

SEQ ID NO: 1259 - DNA, 1555 bp, Moorella thermoacetica
gtttgatcctggctcaggacaaacgctggcggcgtgcctaacacatgcaagtcgagcggtctttaattggggaaatcttcggatggaaccgattaaagatagcggcggacgggtgagtaacgcgtgggtaatctacccttcagactgggataacaccgggaaactggtgctaataccggatacggtctacgggaggcatcttctgtagaagaaaggtggcgcaagctaccgctgaaggatgagcccgcgtcccattagctagttggtgaggtaacggctcaccaaggcgacgatgggtagccggcctgagagggtggtcggccacactgggactgagacacggcccagactcctacgggaggcagcagtggggaatcttgcgcaatgggcgaaagcctgacgcagcaacgccgcgtgagcgatgaaggccttcgggttgtaaagctctgtcatcagggacgaagtcttaaaggcgaatagcctttaaggtgacggtacctgaggaggaagccccggctaactacgtgccagcagccgcggtaaaacgtagggggcgagcgttgtccggaattactgggcgtaaagggcgtgtaggcggcctggcaagtcagatgtgaaaaaccccggcttaaccgggggcatgcatttgaaactgccgggcttgagggcaggagaggagagtggaattcccggtgtagcggtgaaatgcgtagatatcgggaggaacaccagtggcgaaggcgactctctggcctggccctgacgctgaggcgcgaaagcgtggggagcaaacaggattagataccctggtagtccacgccgtaaacgatgggtactaggtgtaggaggtatcgaccccttctgtgccgcagtaaacacaataagtaccccgcctggggagtacggccgcaaggctgaaactcaaaggaattgacgggggcccgcacaagcggtggagcatgtggtttaattcgacgcaacgcgaagaaccttaccggggtttgacatcctgcgaacctggtggaaacactggggtgcccttcggggaacgcagagacaggtggtgcatggttgtcgtcagctcgtgtcgtgagatgttgggttaagtcccgcaacgagcgcaacccctacctttagttgccagcgggtaaagccgggcactctaaagggactgccggtgacaaaccggaggaaggtggggatgacgtcaaatcatcatgccccttatatcccgggctacacacgtgctacaatggcctgtacaaaggggtgcgaaggagcgatccggagcgaatcccaaaaagcaggtctcagttcggattgcaggctgcaactcgcctgcatgaagtcggaatcgctagtaatcgcggatcagcatgccgcggtgaatacgttcccgggccttgtacacaccgcccgtcacaccacgaaagctggcaacacccgaagccggtgacctaacccgcgagggaaggagccgtctaaggtggggctggtgattggggtgaagtcgtaacaaggtagccgtatcggaaggtgcggctggatcacctcc

SEQ ID NO: 1260 - DNA, 1532 bp, Moraxella catarrhalis
ttaaactgaagagtttgatcatggctcagattgaacgctggcggcaggcttaacacatgcaagtcgaacgaagttaggaagcttgcttctgatacttagtggcggacgggtgagtaatgcttaggaatctgcctagtagtgggggataacttggggaaacccaagctaataccgcatacgacctacgggtgaaagggggcttttagctctcgctattagatgagcctaagtcggattagctggttggtggggtaaaggcctaccaaggcgacgatctgtagctggtctgagaggatgatcagccacactgggactgagacacggcccagactcctacgggaggcagcagtggggaatattggacaatgggcgaaagcctgatccagccatgccgcgtgtgtgaagaaggccttttggttgtaaagcactttaagtggggaggaaaagcttatggttaatacccataagccctgacgttacccacagaataagcaccggctaactctgtgccagcagccgcggtaatacagagggtgcaagcgttaatcggaattactgggcgtaaagcgcgcgtaggtggttatttaagtcagatgtgaaagccccgggcttaacctgggaactgcatctgatactggataactagagtaggtgagaggggagtagaattccaggtgtagcggtgaaatgcgtagagatctggaggaataccgatggcgaaggcagctccctggcatcatactgacactgaggtgcgaaagcgtgggtagcaaacaggattagataccctggtagtccacgccgtaaacgatgtctaccagtcgttgggtcttttaaagacttagtgacgcagttaacgcaataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatcttgcagagatgcgagagtgccttcgggaattcacatacaggtgctgcatggctgtcgtcagctcgtgtcgtgagatgttgggttaagtcccgcaacgagcgcaacccttttccttagttaccagcgactcggtcgggaactctaaggatactgccagtgacaaactggaggaaggcggggacgacgtcaagtcatcatggcccttacgaccagggctacacacgtgctacaatggttggtacaaagggttgctacacagcgatgtgatgctaatctcaaaaagccaatcgtagtccggattggagtctgcaactcgactccatgaagtcggaatcgctagtaatcgcagatcagaatgctgcggtgaatacgttcccgggccttgtacacaccgcccgtcacaccatgggagttgatctcaccagaagtggttagcctaacgcaagagggcgatcaccacggtggggtcgatgactggggtgaagtcgtaacaaggtagccgtaggggaacctgcggctggatcacctcctta

SEQ ID NO: 1261 - DNA, 1501 bp, Moraxella lincolnii
attgaacgctggcggcaggcttaacacatgcaagtcgaacgaagaggtctagcttgctagactgattagtggcgaacgggtgagtaacatttaggaatctaccttatagagggggatagctcggggaaactcgaattaataccgcatacgacctacgggtgaaagggggcgcaagctcttgctataagatgagcctaaaccagattagctagttggtggggtaaaggcctaccaaggcgacgatctgtagctggtctgagaggatgatcagccacactgggactgagacacggcccagactcctacgggaggcagcagtggggaatattggacaatgggcgaaagcctgatccagccatgccgcgtgtgtgaagaaggccttatggttgtaaagcacttttaagtggggagaaaagcttatggataacacccataggttctgacgttacccacagaataagcaccggctaactctgtgccagcagccgcggtaatacagagggtgcaagcgttaatcggaattactgggcgtaaagcgagcgtaggtggtttattaagtcagatgtgaaatccctgggcttaacctaggaactgcatctgatactgataaactagagtaggtgagaggaaagtagaattccaggtgtagcggtgaaatgcgtagagatctggaggaataccgatggcgaaggcagctttctggcatcatactgacactgaggttcgaaagcgtgggtagcaaacaggattagataccctggtagtccacgccgtaaacgatgtctaccagtcgttgggtcttttaaaggcttagtgacgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatcttgcagagatgcgagagtgcctttgggaattcacatacaggtgctgcatggctgtcgtcagctcgtgtcgtgagatgttgggttaagtcccgcaacgagcgcaacccttttccttagttaccagcgacttggtcggggactttaaggacactgccagtgacaaactggaggaaggcggggacgacgtcaagtcatcatggcccttacgaccagggctacacacgtgctacaatggtaggtacagagggcagctacacggcgacgtgatgccaatctcaaaaagcctatcttagtccagattggagtctgcaactcgactccatgaagtcggaatcgctagtaatcgcggatcagaatgccgcggtgaatacgttcccgggccttgtacacaccgcccgtcacaccatgggagttgattgcaccagaagtggttagcctaacttaggagggcgatcaccacggtgtggttaatgactggggtgaagtcgtaacaaggtagccgtaggggaacctgcggctggatcacctcctta

SEQ ID NO: 1262 - DNA, 1522 bp, Moraxella osloensis
tagagtttgatcatggctcagattgaacgctggcggcaggcttaacacatgcaagtcgaacgatgactctctagcttgctagagatgattagtggcggacgggtgagtaacatttaggaatctacctagtagtgggggatagctcggggaaactcgaattaataccgcatacgacctacgggtgaaagggggcgcaagctcttgctattagatgagcctaaatcagattagctagttggtggggtaaaggcccaccaaggcgacgatctgtaactggtctgagaggatgatcagtcacaccggaactgagacacggtccggactcctacgggaggcagcagtggggaatattggacaatgggggcaaccctgatccagccatgccgcgtgtgtgaagaaggccttttggttgtaaagcactttaagcagggaggagaggctaatggttaatacccattagattagacgttacctgcagaataagcaccggctaactctgtgccagcagccgcggtaatacagagggtgcgagcgttaatcggaattactgggcgtaaagcgagtgtaggtggctcattaagtcacatgtgaaatccccgggcttaacctgggaactgcatgtgatactggtggtgctagaatatgtgagagggaagtagaattccaggtgtagcggtgaaatgcgtagagatctggaggaataccgatggcgaaggcagcttcctggcataatattgacactgagattcgaaagcgtgggtagcaaacaggattagataccctggtagtccacgccgtaaacgatgtctactagccgttggggtccttgagactttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatctttcagagatgagagagtgccttcgggaactcacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtaggtacagagggttgctacacagcgatgtgatgctaatctcaaaaagcctatcgtagtccggattggagtctgcaactcgactccatgaagtcggaatcgctagtaatcgcggatcagaatgccgcggtgaatacgttcccgggccttgtacacaccgcccgtcacaccatgggagtctattgcaccagaagtaggtagcctaacgaaagagggcgcttaccacggtgtggtcgatgactggggtgaagtcgtaacaaggtagccgtaggggaacctgcggttggatcacctc

SEQ ID NO: 1263 - DNA, 1450 bp, Moraxella sp.
  16285
attgaacgctggcggcaggcttaacacatgcaagtcgaacgatrgaacctagcttgctaggggaaatagtggcgaacgggtgagtaacatttaggaaactgccttatagagggggatagctcggggaaactcgaattaataccgcatacgtcctacgggagaaaggagctttagggttctgctataagatgtgcctaaattagattagctagatggtgaggtaaaggctcaccatggcgacgatctataactggtcttagaggatgatcagtcacaccggaactgagacacggtccggactcctacgggaggcagcagtggggaatattggacaatgggggcaaccctgatccagccatgccgcgtgtgtgaagaaggtcataagattgtaaagcactttaagcagggaggaagagccagtggagaaacacactggtggtgacgttacctgcagaataagcaccggctaactctgtgccagcagccgcggtaatacagagggtgcgagcgttaatcggaattactgggcgtaaagcgggtgcaggtggtgcactaagtcatatgtgaaagccctgggcttaacctaggaacagcatatgatactggtgaactagagtatatgagaggraagtagaattccaggtgtagcggtgaaatgcgtagagatctggaggaataccgatggcgaaggcagctttctggcacaatactgacactcagacccgaaagcgtgggtagcaaacaggattagataccctggtagtccacgccgtaaacgatgtctactagccgttggrgctcatgaagcyttagtggcgcagctaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagratcctacagagatgtgggagtgccythgggaaytcacatacaggtgctgcatggctgtcgtcagctcgtgtcgtgagatgttgggttaagtcccgcaacgagcgcaacccttatccttacttgctagcrggtaragcygagaactgtaaggagactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccggattggagtctgcaactcgactycatgaagtcggaatcgctagtaatcgcagatcagaatgctgcggtgaatacgttcccgggccttgtacacaccgcccgtcacaccatgggagtctattgcaccagaagtaggtagcctaacgcaagagggcgcttaccacggtgtggtcgatgactggggtg

SEQ ID NO: 1264 - DNA, 1226 bp, Moraxella sp.
  GM2
ctggctcagattgaacgctggcggcaggcttaacacatgcaagtcgaacgagtggcggacgggtgagtaacatttaggaatctgcctagtagtgggggatagctcggggaaactcgaattaataccgcatacggaaagttgctattagatgagcctaaatcagattagctagttggtggggtaaaggcccaccaaggcgacgatctgtaactggtctgagaggatgatcagtcacaccggaactgagacacggtccggactcctacgggaggcagcagtggggaatattggacaatgggggcaaccctgatccagccatgccgcgtgtgtgaagaaggccttttggttgtaaagcactttaagcagggaggaagacgttacctgcagaataagcaccggctaactctgtgccagcagccgcggtaatacagagggtgcgagcgttaatcggaattactgggcgtaaagcgagtgtaggtggctcattaagtcacatgtgaaatccccgggcttaacctgggaactgcatgtgatactggtgggctagaatatgtgagagggaagtagaattccaggtgtagcggtgaaatgcgtagagatctggaggaataccgatggcgaaggcagcttcctggcataattgacactgagattcgaaagcgtgggtagcaaacaggattagataccctggtagtccacgccgtaaacgatgtctactagccgttggggctttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatatacaggtgctgcatggctgtcgtcagctcgtgtcgtgagatgttgggttaagtcccgcaacgagcgcaacccttttccttatttgccagcggccgggaactttaaggatactgccagtgacaaactggaggaaggcggggacgacgtcaagtcatcatggcccttacgaccagggctacacacgtgctacaatggtaggcagagggttgctacacagcgatgtgatgctaatctcaacctatcgtagtccggatggagtctgcaactcgactccagaagtcggaatcgctagtaatcgcagatcagaatgctgcggtgaatacgttcccgggccttgtacacaccg

SEQ ID NO: 1265 - DNA, 1402 bp, Morganella morganii
tcgggcggtaacagggagaagcttgcttctctgctgacgagcggcggacgggtgagtaatgtatggggatctgcctgatggcgggggataactactggaaacggtagctaataccgcataatgtcttcggaccaaagcgggggacctccgggcctcgcgccatcagatgaacccatatgggattagctagtaggtgaggtaacggcttacctaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccttcgggttgtaaagtactttcagtcgggaggaaggtggtaaggttaataaccttggcaattgacgttaccgacagaagaagcaccggctaactccgtgccagcagccgcggtaatacggagggtgcaagcgttaatcggaattactgggcgtaaagcgcacgcaggcggttgattgagtcagatgtgaaatccccgggcttaacccgggaattgcatctgatactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagacatggattggagccttcgggaactctgagacggttaacccgggaattgcatctgatagtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcgtatacaaagggaagcgaccccgcgagggcaagcggaactcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaacctccgggagggcgc

SEQ ID NO: 1266 - DNA, 1495 bp, Morganella sp.
  JB-T16
attgaacgctggcggcaggcctaacacatgcaagtcgggcggtaacagggagaagcttgcttctctgctgacgagcggcggacgggtgagtaatgtatggggatctgcctgatggagggggataactactggaaacggtagctaataccgcataatgtctccggaccaaagcgggggaccttcgggcctcgcaccatcagatgaacccatatgggattagctagtaggtgaggtaatggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagtcgggaggaaggtgttgagtttaatatgctcagcaattgacgttaccgacagaagaagcaccggctaactccgtgccagcagccgcggtaatacggagggtgcaagcgttaatcggaattactgggcgtaaagcgcacgcaggcggttgattaagtcagatgtgaaatccccgggctcaacccgggaattgcatctgagactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcrcgtaatggygggaactcaaaggagactgccggtgataaaccggaggaaggtggggatgacgtcaagtcatcatggcccttacgagtagggctacacacgtgctacaatggcgtatacaaagggaagcgacctcgcgagagcaagcggaactcacaaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacc

SEQ ID NO: 1267 - DNA, 1427 bp, Morococcus cerebrosus
atgcaagtcggacggcagcacagagaagcttgcttcttgggtggcgagtggcgaacgggtgagtaacatatcggaacgtaccgagcagtgggggataactaatcgaaagattagctaataccgcatatattctgaggaagaaagcaggggaccatttggccttgcgctgtttgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgaaagcctgatccagccatgccgcgtgtctgaagaaggccttcgggttgtaaaggacttttgtcagggaagaaaagggcggggttaatacccctgtctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcgattagctgttgggcagcatgactgcttagtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatg

SEQ ID NO: 1268 - DNA, 1331 bp, Moryella indoligenes
gcgtgcttaacacatgcaagtcgaacgagtggcggacgggtgagtaacgcgtggggaacctgcctcatacagggggataacagttggaaacgactgttaataccgcataagaaaaagtggtatgagatggacccgcgttcgattagccagttggcggggtaacggcccaccaaagcgacgatcgatagccgatttgagagaatgaccggccacattgggactgagacacggcccaaactcctacgggaggcagcagtggggaatattgcacaatggggggaaccctgatgcagcgacgccgcgtgagtgaagaagtatttcggtatgtaaagctctatcagcagggaagatgacggtacctgagtaagaagccccggctaactacgtgccagcagccgcggtaatacgtagggggcaagcgttatccggatttactgggtgtaaagggagcgcagacggctatgcaagtctgaagtgaaagcccggggctcaaccccgggactgctttggaaactgtgtagctagagtgtcggagaggtaagcagaattcccagtgtagcggtgaaatgcgtagatattgggaagaataccggtggcgaaggcggcttactggacgaactgacgttcaggctcgaaggcgtggggagcaaacaggattagataccctggtagtccacgcggtaaacgatgaatactaggtgttggcatgtcggtgccgtcgcaaacgcaataagtattccacctggggagtacgttcgcaagaatgaaactcaaaggaattgacggggacccgcacaagcagtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccctattgccagtagccagcagctgggcactctggcgagactgcctgggataaccaggaggaaggtggggatgacgtcaaatcatcatgccccttatgatttgggcaacacacgtgctacaatggcgtacagagagaagcgaaggagcgatccggagcgaatctaaaacgtctcagttcggatgcagtctgcaactcgactgcagaagctggaattgctagtaatcgcgaatcagcatgtcgcggtgaatacgttcccgggtcttgtacacaccgcccgtcacaccatgggagtcagcaacgcccgaagtcagtacccagggagctgccgaaggcggggcggataactggggtgaagtcgtaacaaggtagccgtatcggaaggtgcggttggatcacctcct

SEQ ID NO: 1269 - DNA, 1526 bp, Mycobacterium abscessus
ttttgtttggagagtttgatcctggctcaggacgaacgctggcggcgtgcttaacacatgcaagtcgaacggaaaggcccttcggggtactcgagtggcgaacgggtgagtaacacgtgggtgatctgccctgcactctgggataagcctgggaaactgggtctaataccggataggaccacacacttcatggtgagtggtgcaaagcttttgcggtgtgggatgagcccgcggcctatcagcttgttggtggggtaatggcccaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagtagggacgaagcgaaagtgacggtacctacagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtgggtagcgaacaggattagataccctggtagtccacgccgtaaacggtgggtactaggtgtgggtttccttccttgggatccgtgccgtagctaacgcattaagtaccccgcctggggagtacggtcgcaagactaaaactcaaaggaattgacgggggcccgcacaagcggcggagcatgtggattaattcgatgcaacgcgaagaaccttacctgggtttgacatgcacaggacgtatctagagataggtattcccttgtggcctgtgtgcaggtggtgcatggctgtcgtcagctcgtgtcgtgagatgttgggttaagtcccgcaacgagcgcaacccttgtcctatgttgccagcgggtaatgccggggactcgtaggagactgccggggtcaactcggaggaaggtggggatgacgtcaagtcatcatgccccttatgtccagggcttcacacatgctacaatggccagtacagagggctgcgaagccgtaaggtggagcgaatcccttaaagctggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaaccttttggagggagctgtcgaaggtgggatcggcgattgggacgaagtcgtaacaaggtagccgtaccggaaggtgcggctggatcacctcctttctaagga

SEQ ID NO: 1270 - DNA, 1433 bp, Mycobacterium africanum
gacgaacgctggcggcgtgcttaacacatgcaagtcgaacggaaaggtctcttcggagatactcgagtggcgaacgggtgagtaacacgtgggtgatctgccctgcacttcgggataagcctgggaaactgggtctaataccggataggaccacgggatgcatgtcttgtggtggaaagcgctttagcggtgtgggatgagcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttctctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttaaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtcgaag

SEQ ID NO: 1271 - DNA, 1376 bp, Mycobacterium alsiensis
ttttgggagtttgatcctggctcaggacgaacgctggcggcgtgcttaacacatgcaagtcgaacgagtggcgaacgggtgagtaacacgtgggtaatctgccctgcacttcgggataagcctgggaaactgggtctaataccgaatagggaaaggcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgatgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactggagtactgcaggggagactggaattcctggtgtagcggtggaatgcgcagatatcaggaggaacaccggtggcgaaggcgggtctctgggcagactgacgctgaggagcgaaagcgtggggagcgaacaggattagataccctggtagtccacgccgtaaacggtgggtactaggtgtgggttgatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgtgcaggtggtgcatggctgtcgtcagctcgtgtcgtgagatgttgggttaagtcccgcaacgagcgcaacccttgtctcatgttgccagcggccggggactcgtgagagactgccggggtcaactcggaggaaggtggggatgacgtcaagtcatcatgccccttatgtccagggcttcacacatgctacaatggccggcaaagggctgcgatgccgcaaggttaagcgaatcctttccggtctcagttcggacggggtctgcaactcgaccccggaagtcggagtcgctagtaatcgcagatcagcaacgctgcggtgaatacgttcccgggccttgtacacaccgcccgtcacgtcatgaaagtcggtaacacccgaagccagtgcctagggagctgtcgaaggtgggatcggcgattgggacgaagtcgtaacaaggtagccgtaccggaaggtgcggctggatcacctcctttct

SEQ ID NO: 1272 - DNA, 1537 bp, Mycobacterium avium
tttgtttggagagtttgatcctggctcaggacgaacgctggcggcgtgcttaacacatgcaagtcgaacggaaaggcctcttcggaggtactcgagtggcgaacgggtgagtaacacgtgggcaatctgccctgcacttcgggataagcctgggaaactgggtctaataccggataggacctcaagacgcatgtcttctggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgtaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaacccttttgggagggagctgtcgaaggtgggatcggcgattgggacgaagtcgtaacaaggtagccgtaccggaaggtgcggctggatcacctcctttct

SEQ ID NO: 1273 - DNA, 1468 bp, Mycobacterium chelonae
gacgaacgctggcggcgtgcttaacacatgcaagtcgaacggaaaggcccttcggggtactcgagtggcgaacgggtgagtaacacgtgggtgatctgccctgcactctgggataagcctgggaaactgggtctaataccggataggaccacacacttcatggtgagtggtgcaaagcttttgcggtgtgggatgagcccgcggcctatcagcttgttggtggggtaatggcccaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagtagggacgaagcgaaagtgacggtacctacagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtgggtagcgaacaggattagataccctggtagtccacgccgtaaacggtgggtactaggtgtgggtttccttccttgggatccgtgccgtagctaacgcattaagtaccccgcctggggagtacggtcgcaagactaaaactcaaaggaattgacgggggcccgcacaagcggcggagcatgtggattaattcgatgcaacgcgaagaaccttacctgggtttgacatgcgcaggacgtatctagagataggtattcccttgtggcctgcgtgcaggtggtgcatggctgtcgtcagctcgtgtcgtgagatgttgggttaagtcccgcaacgagcgcaacccttgtcctatgttgccagcgggtaatgccggggactcgtaggagactgccggggtcaactcggaggaaggtggggatgacgtcaagtcatcatgccccttatgtccagggcttcacacatgctacaatggccagtacagagggctgcgaagccgcaaggtggagcgaatcccttaaagctggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaaccttttggagggagctgtcgaaggtgggatcggcgattgggacgaagtcgtaacaaggtagccgtaccggaagg

SEQ ID NO: 1274 - DNA, 1481 bp, Mycobacterium colombiense
catgcaagtcgaacggaaaggcctcttcggaggtactcgagtggcgaacgggtgagtaacacgtgggcaatctgccctgcacttcgggataagcctgggaaactgggtctaataccggataggacctttagacgcatgtcttttggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgtaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaaccttttggagggagctgtcgaaggtgggatcggcgattgggacgaagtcgtaacaaggtagccgtaccggaaggtgcggctggatcacctccttttct

SEQ ID NO: 1275 - DNA, 1475 bp, Mycobacterium elephantis
agtttgatcctggctcaggacgaacgctggcggcgtgcttaacacatgcaagtcgaacggaaaggccccttcgggggtgctcgagtggcgaacgggtgagtaacacgtgggtgatctgccctgcactttgggataagcctgggaaactgggtctaataccgaatacaccctgctggtcgcatggcctggtgggggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacccctttcagtatcgacgaagccgtgaggtgacggtaggtacagaagaagcaccggccaactacgtgccagcagccgcggtaatacgtagggtgcgagcgttgtccggaattactgggcgtaaagagctcgtaggtggtttgtcgcgttgtccgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtgatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccgcaagggagggagccgtcgaaggtgggatcggcgattgggacgaagtcgtaac

SEQ ID NO: 1276 - DNA, 1485 bp, Mycobacterium gordonae
tagagtttgaatcatggctcaggacgaacgctggcggcgtgcttaacacatgcaagtcgaacggtaaggcccttcggggtacacgagtggcgaacgggtgagtaacacgtgggtaatctgccctgcacatcgggataagcctgggaaactgggtctaataccgaataggaccacagaacacatgtcctgtggtggaaagcttttgcggtgtgggatgggcccgcggcctatcagcttgttggtggggtgatggcccaccaaggcgacgacgggtagccggcctgagagggtgtccggccacactgggactgagatacggcccagactcctacgggaggcagcagtggggaatattgcacaatgggcgaaagcctgatgcagcgacgccgcgtgggggatgacggccttcgggttgtaaacctctttcaccatcgacgaaggttcgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacagagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaaca

SEQ ID NO: 1277 - DNA, 1495 bp, Mycobacterium intracellulare
agagtttgatcctggctcaggacgaacgctggcggcgtgcttaacacatgcaagtcgaacggaaaggccccttcgggggtactcgagtggcgaacgggtgagtaacacgtgggcaatctgccctgcacttcgggataagcctgggaaactgggtctaataccggataggacctttaggcgcatgtctttaggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaacccttgggagggagctgtcgaaggtgggatcggcgattgggacgaagtcgtaacaaggtagccgta

SEQ ID NO: 1278 - DNA, 1469 bp, Mycobacterium kansasii
gacgaacgctggcggcgtgcttaacacatgcaagtcgaacggaaaggtctcttcggagacactcgagtggcgaacgggtgagtaacacgtgggcaatctgccctgcacaccgggataagcctgggaaactgggtctaataccggataggaccacttggcgcatgccttgtggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttctctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtcgaaggtgggatcggcgattgggacgaagtcgtaacaaggta

SEQ ID NO: 1279 - DNA, 1314 bp, Mycobacterium lacus
gacgaacgctggcggcgtgcttaacacatgcaagtcgaacgagtggcgaacgggtgagtaacacgtgggtgatctgccctgcacttcgggataagcctgggaaactgggtctaataccggatagggaaaggcggtgtgggatgagcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgatgacggtagatggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactggagtactgcaggggagactggaattcctggtgtagcggtggaatgcgcagatatcaggaggaacaccggtggcgaaggcgggtctctgggcagactgacgctgaggagcgaaagcgtggggagcgaacaggattagataccctggtagtccacgccgtaaacggtgggtactaggtgtgggttgatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgtgcaggtggtgcatggctgtcgtcagctcgtgtcgtgagatgttgggttaagtcccgcaacgagcgcaacccttgtctcatgttgccagcggccggggactcgtgagagactgccggggtcaactcggaggaaggtggggatgacgtcaagtcatcatgccccttatgtccagggcttcacacatgctacaatggccggcaaagggctgcgatgccgcgaggttaagcgaatcctttccggtctcagttcggacggggtctgcaactcgaccccggaagtcggagtcgctagtaatcgcagatcagcaacgctgcggtgaatacgttcccgggccttgtacacaccgcccgtcacgtcatgaaagtcggtaacacccgaagccagtgcctagggagctgtcgaaggtgggatcggcgattgggacgaagtcgtaacaaggta

SEQ ID NO: 1280 - DNA, 1553 bp, Mycobacterium leprae
tttgtttggagagtttgatcctggctcaggacgaacgctggcggcgtgcttaacacatgcaagtcgaacggaaaggtctctaaaaaatcttttttagagatactcgagtggcgaacgggtgagtaacacgtgggtaatctgccctgcacttcagggataagcttgggaaactgggtctaataccggataggacttcaaggcgcatgtcttgtggtggaaagctttttgcggtgcaggatgggcccgcggcctatcagcttgttggtggggtgacggcctaccaaggcgacgacgggtagccggcctgagagggtgtacggccacactgggactgagatacggcccagactcctacgggaggcagcagtggggaatattgcacaatgggcgcaagcctgatgcagcgacgccgcgtgggggatgacggctttcgggttgtaaacctctttcaccatcgacgaaggtctgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactggagtactgcaggggagactggaattcctggtgtagcggtggaatgcgcagatatcaggaggaacaccagtggcgaaggcgggtctctgggcagtaactgacgctgaggagcgaaagcgtggggagcaaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggatgcgtctagagataggcactcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccgcggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtccaaggtgggatcggcgattgggacgaagtcgtaacaaggtagccgtaccggaaggtgcggctggatcacctcctttctaagg

SEQ ID NO: 1281 - DNA, 1538 bp, Mycobacterium lepromatosis
agagtttgatcctggctcaggacgaacgctggcggcgtgcttaacacatgcaagtcgaacggaaaggtctcttaatacttaaacctattaaagatactcgagtggcgaacgggtgagtaacacgtgggtaatctaccctgcacttcagggataagcctgggaaaccgggtctaataccggataggacttcaaggcgcatgtcttgtggtggaaagcttttgcggtgcgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggctttcgggttgtaaacctctttcaccattgacgaagatctgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacggggcccgcacaagcggcggagcatgtggattaattcgatgcaacgcgaagaaccttacctgggtttgacatgcacaggacgcgtctagagataggcgttcctttttggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccgcggtcaactcggaggaaggtggggatgacgtcaagtcatcatgccccttatgtccagggcttcacacatgctacaatggccggtacaaagggctgcgatgccgcaaggttaagcgaatccttattaaagccggtctcagttcggatcggggtctgcaactcgaccccgtgaagccggagtcgctagtaatcgcagatcagcaacgctgcggtgaatacgttcccgggccttgtacacaccgcccgtcacgtcatgaaagtcggtaacacccgaagccagtggcctaaccctcgggagggagctgtcgaaggtgggatcggcgattgggacgaagtcgtaacaaggtagccgtaccggaaggtgcggttggatcacctcct

SEQ ID NO: 1282 - DNA, 1310 bp, Mycobacterium mageritense
gacgaacgctggcggcgtgcttaacacatgcaagtcgaacgagtggcgaacgggtgagtaacacgtgggtgatctgccctgcactttgggataagcctgggaaactgggtctaataccgaatagggaaaggcggtgtgggatgggcccgcggcctatcagcttgttggtggggtgatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagcaagacgatgacggtatgtgcagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagactgacgctgaggagcgaaagcgtggggagcgaacaggattagataccctggtagtccacgccgtaaacggtgggtactaggtgtgggttgatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgtgcaggtggtgcatggctgtcgtcagctcgtgtcgtgagatgttgggttaagtcccgcaacgagcgcaacccttgtctcatgttgccagcacgtggggactcgtgagagactgccggggtcaactcggaggaaggtggggatgacgtcaagtcatcatgccccttatgtccagggcttcacacatgctacaatggccggcaaagggctgcgatgccgtgaggtggagcgaatcctttccggtctcagttcggacggggtctgcaactcgaccccggaagtcggagtcgctagtaatcgcagatcagcaacgctgcggtgaatacgttcccgggccttgtacacaccgcccgtcacgtcatgaaagtcggtaacacccgaagccggtgcctagggagccgtcgaaggtgggatcggcgattgggacgaagtcgtaacaag

SEQ ID NO: 1283 - DNA, 1471 bp, Mycobacterium mantenii
tggttcaggacgaacgctggcggcgtgcttaacacatgcaagtcgaacggaaaggcctcttcggaggtactcgagtggcgaacgggtgagtaacacgtgggcaatctgccctgcacttcgggataagcctgggaaactgggtctaataccgaataggaccacttggcgcatgccttgtggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggctcactttgtgggttgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgtaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaacaa

SEQ ID NO: 1284 - DNA, 1535 bp, Mycobacterium marinum
tttgtttggagagtttgatcctggctcaggacgaacgctggcggcgtgcttaacacatgcaagtcgaacggaaaggtctcttcggagatactcgagtggcgaacgggtgagtaacacgtgggcgatctgccctgcacttcgggataagcctgggaaactgggtctaataccggataggaccacgggattcatgtcctgtggtggaaagcttttgcggtgtgggatgggcccgcggcctatcagcttgttggtggggtaacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggttcgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatcctttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaacaaggtagccgtaccggaaggtgcggctggatcacctcctttct

SEQ ID NO: 1285 - DNA, 1484 bp, Mycobacterium microti
gacgaacgctggcggcgtgcttaacacatgcaagtcgaacggaaaggtctcttcggagatactcgagtggcgaacgggtgagtaacacgtgggtgatctgccctgcacttcgggataagcctgggaaactgggtctaataccggataggaccacgggatgcatgtcttgtggtggaaagcgctttagcggtgtgggatgagcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttctctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatgaccggtacaaagggctgcgatgccgcgaggttaagcgaatccttaaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtcgaaggtgggatcggcgattgggacgaagtcgtaacaaggtagccgtaccggaagg

SEQ ID NO: 1286 - DNA, 1273 bp, Mycobacterium neoaurum
tggcgaacgggtgagtaacacgtgggtgatctgccctgcactttgggataagcctgggaaactgggtctaataccgaatatgatcatcggcttcatggtcggtggtggaaagcttttgcggtgtgggatgggcccgcggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagcacagacgaagcgcaagtgacggtatgtgcagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgctggtagagatatcagttcccttgtggcctgtgtgcaggtggtgcatggctgtcgtcagctcgtgtcgtgagatgttgggttaagtcccgcaacgagcgcaacccttgtcctatgttgccagcgggttatgccggggactcgtaggagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggcct

SEQ ID NO: 1287 - DNA, 1523 bp, Mycobacterium parascrofulaceum
tttgtttggagagtttgatcctggctcaggacgaacgctggcggcgtgcttaacacatgcaagtcgaacggaaaggtctcttcggagatactcgagtggcgaacgggtgagtaacacgtgggcaatctgccctgcacttcgggataagcctgggaaactgggtctaataccggataggaccacttggcgcatgccttgtggtggaaagcttttgcggtgtgggatgggcccgcggcctatcagctagttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagcagggacgaagcgcaagtgacggtacctgcagaagaagcaccggccaactacgtgccagcagccgcggtaatacgtagggtgcgagcgttgtccggaattactgggcgtaaagagctcgtaggtggtttgtcgcgttgttcgtgaaaaccgggggcttaaccctcggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaacccttgggagggagctgtcgaaggtgggatcggcgattgggacgaagtcgtaacaaggtagccgtaccggaaggtgcggctggatcacctcctttct

SEQ ID NO: 1288 - DNA, 1417 bp, Mycobacterium paraterrae
tgcttaacacatgcaagtcgaacggaaaggccctttcgggggtactcgagtggcgaacgggtgagtaacacgtgggtgatctgccctgcactttgggataagcctgggaaactgggtctaataccgaataggaccacgcgcttcatggtgtgtggtggaaagcttttgcggtgtgggatgggcccgcggcctatcagcttgttggtggggtaatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagtatcggcgaagctccaggattcttcttggggtgacagtaggtacagaagaagcaccggccaactacgtgccagcagccgcggtaatacgtagggtgcgagcgttgtccggaattactgggcgtaaagagctcgtaggtggtttgtcacgttgtccgtgaaaactcacagcttaactgtgggcgtgcgggcgatacgggcagactggagtactgtaggggagactggaattcctggtgtagcggtggaatgcgcagatatcaggaggaacaccggtggcgaaagcgggtctctgggcagtaactgacgctgaggagcgaaagcgtggggagcgaacaggattagataccctggtagtccacgccgtaaacggtgggtactaggtgtgggtttccttcctttagggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggtagagatatcggttcccttgtggcctgtgtgcaggtggtgcatggctgtcgtcagctcgtgtcgtgagatgctgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatcccgtgagggttagcgaatcctttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcga

SEQ ID NO: 1289 - DNA, 1486 bp, Mycobacterium phlei
tagagtttgatcatggctcaggacgaacgctggcggcgtgcttaacacatgcaagtcgaacggaaaggccccttcgggggtactcgagtggcgaacgggtgagtaacacgtgggtgatctgccctgcactctgggataagcctgggaaactgggtctaataccggatacacccttctggttgcatggctgggaggggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacccctttcagtagggacgaagcgtgagtgacggtacctacagaagaagcaccggccaactacgtgccagcagccgcggtaatacgtagggtgcgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgacggcagagatgtcgtttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagaccgccggggtcaactcggaggaaggtggggatgacgtcaagtcatcatgccccttatgtccagggcttcacacatgctacaktggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggagccgc

SEQ ID NO: 1290 - DNA, 1522 bp, Mycobacterium seoulense
gagagtttgatcctggctcaggacgaacgctggcggcgtgcttaacacatgcaagtcgaacggaaaggccccttcgggggtactcgagtggcgaacgggtgagtaacacgtgggcaatctgccctgcacttcgggataagcctgggaaactgggtctaataccgaataggaccacttggcgcatgccttgtggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggtttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaacccttgggagggagctgtcgaaggtgggatcggcgattggacgaagtcgtaacaaggtagccgtaccggaaggtgcggctggatcacctcctt

SEQ ID NO: 1291 - DNA, 1525 bp, Mycobacterium smegmatis
ttgtttggagagtttgatcctggctcaggacgaacgctggcggcgtgcttaacacatgcaagtcgaacggaaaggccctttcgggggtactcgagtggcgaacgggtgagtaacacgtgggtgatctgccctgcactttgggataagcctgggaaactgggtctaataccgaatacaccctgctggtcgcatggcctggtaggggaaagcttttgcggtgtgggatgggcccgcggcctatcagcttgttggtggggtgatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagcacagacgaagcgcaagtgacggtatgtgcagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttct

SEQ ID NO: 1292 - DNA, 1478 bp, Mycobacterium sp.
  1761
gaacgctggcggcgtgcttaacacatgcaagtcgaacgtgaaggcttccttcggcatagtcgagtggcgaacgggtgagtaacacgtgggtgatctgccctgcacttcgggataagcttgggaaactgggtctaataccggatagacgctgctacccgcatgccttttggtggaaagcttttgcggtgtgggatgggcccgcggcctatcagcttgttggtgaggtaacggcctaccaaggcgacgacgggtagccggcctgagagggtgtccggccacactgggactgagatacggcccagactcctaccgggagcagcagtggggaatattgcacaatgggcgcaagcctgatgcagcgacgccgcgtgggggatgacggccttcgggtggtaaacctctttcaccatcgacgaaggtcctggtcttctccgattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccatagctaacgcattaagtaccccgcctgaggagtacggccgcaaggctaaaactcaaaggaattgacgggggcccgcaccagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtttcatgttgccagcgggtaatgccggggactcgtgagagactgccggggtcaactcggaggaaggtggggatgacgtcaagtcatcatgccccttatgtccagggcttcacacatgctacaatggccggtacaaagggccgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacaccccgcccgtcacgtcatgaaagtcggtaacacccgaagccagtggcctaacccctccggagggagctgtcgaaggtgggatcggcgattgggacgaagtcgtaacaaggtagccgtaccgg

SEQ ID NO: 1293 - DNA, 1507 bp, Mycobacterium sp.
  1776
ctggcggcgtgcttaacacatgcaagtcgaacggaaaggcccctttcggaaggtactcgagtggcgaacgggtgagtaacacgtgggtgatctgccctgcacttcgggataagcctgggaaactgggtctaataccggataggaccacctgtcgcatggtgtgtggtggaaagcttttgcggtgtgggatgggcccgcggcctatcaacttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaagctgcgggttttctcctggtgacagtatgtggagaagaagcaccggccaactacgtgccagcagccgcggtaatacgtagggtgcaagcgttgtccggaattactgggcgtaaagagctcgtaggtggtttgtcccgttgttcgtgaaatgacacagcttaactgtgggcgtgcgggcgatacgggcatactgtagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttctttcctaaggatccgtgccgtagctaacgcattaaataccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaaccctcgtctcatgttgccagcgcgtgatggcggggactcgtgagagactgccggggtcaactcggaggaaggtggggatgacgtcaagtcatcatgccccttatgtccagggcttcacacatgctacaatggccggtacaaagggctgcgatgccgtgaggttaaaccaatccttgtaaagccggtctcagttcggatcggggtctgcaactcgaccccgtgaagtcgaagtcgctagtaatcgcagatcagcaacgctgcggtgaatacgttcccgggccttgtacacaccgcccgtcacgtcatgaaagtcggtaacacccgaagccggtggcctaacccgtttgggagggagccgtcgaaggtgggatcgacgattgggacgaagtcgtaacaaggtagccgtaccggaaggtgctgctgataaacccacctcaataaaa

SEQ ID NO: 1294 - DNA, 1487 bp, Mycobacterium sp.
  1781
catgccgggctgctaccatgcaagtcgacggaaggcccctttcggggggtactcgagtggcgaacgggtgagtaacacgtgggtgatctgccctgcacttcgggataagcttgggaaactgggtctaataccggataggaccacatgtcgcatggtgtgtggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaagctgcgggttttctcgtggtgacggtaggtggagaagaagcaccggccaactacgtgccagcagccgcggtaatacgtagggtgcgagcgttgtccggaattactgggcgtaaagagctcgtaggtggtttgtcgcgttgttcgtggaatgccacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggttctttcctaaggatccgtgccgtagctaacgcattaagtaccccgcctggggagtacggccgcaaggctaaaactcaaaggaattgacggggggcccgcacaagcggcgggagcatgtggattaattcgatgcaacgcggaagaacctttacctgggtttgacatgcacaggacgcgtctagagataggcgtttcccttgtggcctgtgtgcaggtggtgcatggctgtcgtcagctcgtgtcgtggagatgttgggttaaggtcccgcaacgaggcgcaacccttgtctcatgttgccagcgcgtgatgggcgggacctcgtggagaagactgcctggggtcacctcggaggaaggtgggggatgacgtccaagtcatcatgccccttatgtccagggcttcacacatgcctacaatggccggtacaaagggctgcgatgccgtgaggatttaagcgaatccttgttaaagctcggtcttcgagttcggaattcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccgtttgggagggagccgtcgaaggtgggatcggcgattggacgaagtcgtaacaagtagcttca

SEQ ID NO: 1295 - DNA, 1472 bp, Mycobacterium sp.
  1791
gaacgctggcggcgtgcttaacacatgcaagtcgaacggaaaggtccttcgggcctactcgagtggcgaacgggtgagtaacacgtgggcaatctgccctgcacttcgggataagcttgggaaactgggtctaataccgggtagaccgcgtcatgcatgtccggtggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggttccggttttcttcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagcccgtggcctaacccgttttggagggagctgtcgaaggtgggatcggcgattgggacgaagtcgtaacaaggtagccgt

SEQ ID NO: 1296 - DNA, 1486 bp, Mycobacterium sp.
  1797
gaacgctggcggcgtgcttaacacatgcaagtcgaacgtgaaggcttccttcggcatagtcgagtggcgaacgggtgagtaacacgtgggtgatctgccctgcacttcgggataagcctgggaaactgggtctaataccggatagacgctgctacccgcatgccttgtggtggaaagcttttgcggtgtgggatgggcccgcggcctatcagcttgttggtgaggtaatggcttaccaaggcgacgacgggtagccggcctgagagggtgtccggccacactgggactgagatacggcccagactcctaccggaagcagcagtggggaatattgcacaatgggcgcaagcctgatgcagcgacgccgcgtgagggatgacggccttcgggttgtaaacctccttcaccatcgacgaatgatctgagtttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgtaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaaccctctctggagggagccgtcgaaggtgggatcggcgattgggacgaagtcgtaacaaggtagccgtaccggaaggt

SEQ ID NO: 1297 - DNA, 1328 bp, Mycobacterium sp.
  AQ1GA4
ggtgagtaacacgtgggtgatctgccctgcactttgggataagcctgggaaactgggtctaataccgaataggactccggactgcatggtctggggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcgcctacgacgaagcgtaagtgacggtagtaggagaagaagcaccggccaactacgtgccagcagccgcggtaatacgtagggtgcgagcgttgtccggaattactgggcgtaaagagctcgtaggtggtttgtcgcgttgttcgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgactgcagagatgtggtttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatccttgttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttg

SEQ ID NO: 1298 - DNA, 1513 bp, Mycobacterium sp.
  B10-07.09.0206
gacgaacgctggcggcgtgcttaacacatgcaagtcgaacggaaaggcccykytygsrgggtgctcgagtggcgaacgggtgagtaacacgtgggtgatctgccctgcacttcgggataagcttgggaaactgggtctaataccggataggactccgagatgcatgtcttggggtggaaagctttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaagctgccgctttttgtggtggtgacggtaggtggagaagaagcaccggccaactacgtgccagcagccgcggtaatacgtagggtgcgagcgttgtccggaattactgggcgtaaagagctcgtaggtggtttgtcgcgttgttcgtgaaattccctggcttaactgggggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcwycyagagatrggkgttcccttgtggcctgtgtgcaggtggtgcatggctgtcgtcagctcgtgtcgtgagatgttgggttaagtcccgcaacgagcgcaacccttgtctcatgttgccagcgcgtgatggcggggactcgtgagagactgccggggtcaactcggaggaaggtggggatgacgtcaagtcatcatgccccttatgtccagggcttcacacatgctacaatggccggtacaaagggctgcgatgccgtgaggtttagcgaatcctttaaagccggtctcagttcggatcggggtctgcaactcgaccccgtgaagtcggagtcgctagtaatcgcagatcagcaatgctgcggtgaatacgttcccgggccttgtacacaccgcccgtcacgtcatgaaagtcggtaacacccgaagcccatggcctaacccgcaagggagggagtggtcgaaggtgggatcggcgattgggacgaagtcgtaacaaggtagccgtaccggaaggtgcggctggatcacctcctttctaa

SEQ ID NO: 1299 - DNA, 1402 bp, Mycobacterium sp.
  GN-10546
catgcaagtcgaacggaaaggccctttcgggggtactcgagtggcgaacgggtgagtaacacgtgggtgatctgccctgcactttgggataagcctgggaaactgggtctaataccgaataggaccgcatgcttcatggtgtgtggtggaaagcttttgcggtgtgggatgggcccgcggcctatcagcttgttggtggggtaatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagtatcggcgaagctccgggatttttcttggggtgacggtaggtacagaagaagcaccggccaactacgtgccagcagccgcggtaatacgtagggtgcgagcgttgtccggaattactgggcgtaaagagctcgtaggtggtttgtcacgttgtccgtgaaaactcacagcttaactgtgggcgtgcgggcgatacgggcagactggagtactgtaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttcctttagggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccagcagagatgttggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatcccgtgagggttagcgaatcctttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagc

SEQ ID NO: 1300 - DNA, 1390 bp, Mycobacterium sp.
  GN-10827
tgcaagtcgaacggaaaggccccttcgggggtgctcgagtggcgaacgggtgagtaacacgtgggtgatctgccctgcactttgggataagcctgggaaactgggtctaataccgaatacaccctgctggtcgcatggcctggtgggggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacccctttcagtatcgacgaagccgtgaggtgacggtaggtacagaagaagcaccggccaactacgtgccagcagccgcggtaatacgtagggtgcgagcgttgtccggaattactgggcgtaaagagctcgtaggtggtttgtcgcgttgtccgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtgatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccgcaagggagggagc

SEQ ID NO: 1301 - DNA, 1383 bp, Mycobacterium sp.
  GN-11124
tcgaacggaaaggccctttcgggggtgctcgagtggcgaacgggtgagtaacacgtgggtgatctgccctgcacttcgggataagcctgggaaactgggtctaataccggataggaccacggtctgcatggattgtggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacccctttcaatagggacgaagcgcaagtgacggtacctatagaagaagcaccggccaactacgtgccagcagccgcggtaatacgtagggtgcgagcgttgtccggaattactgggcgtaaagagctcgtaggtggtttgtcgcgttgtccgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccg

SEQ ID NO: 1302 - DNA, 1404 bp, Mycobacterium sp.
  GN-9188
catgcaagtcgaacggaaaggccctttcgggggtactcgagtggcgaacgggtgagtaacacgtgggtgatctgccctgcactttgggataagcctgggaaactgggtctaataccgaatatgatcatgcgcctcatggtgtgtggtggaaagcttttgcggtgtgggatgggcccgcggcctatcagcttgttggtggggtaatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagtatcggcgaagctccagggttttctttggggtgacggtaggtacagaagaagcaccggccaactacgtgccagcagccgcggtaatacgtagggtgcgagcgttgtccggaattactgggcgtaaagagctcgtaggtggtttgtcgcgttgtccgtgaaaactcacagctcaactgtgggcgtgcgggcgatacgggcagactggagtactgtaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttcctttagggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggtagagatatcggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgataccgtgaggtttagcgaatcctttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccg

SEQ ID NO: 1303 - DNA, 1386 bp, Mycobacterium sp.
  GR-2007-210
agtcgaacggaaaggcccttcggggtactcgagtggcgaacgggtgagtaacacgtgggtgatctgccctgcactttgggataagcctgggaaactgggtctaataccgaatacaccctgctggccgcatggtctggtgggggaaagcttttgcggtgtgggatgggcccgcggcctatcagcttgttggtgaggttacggctcaccaaggcgacgacgggtagccggcctgagagggtgatcggccacactgggactgagatacggcccagactcctacgggaggcagcagtggggaatattgcacaatgggcgcaagcctgatgcagcgacgccgcgtgggggatgacggccttcgggttgtaaacctctttcagtagggacgaagcgcaagtgacggtacctacagaagaaggaccggccaactacgtgccagcagccgcggtaatacgtagggtccgagcgttgtccggaattactgggcgtaaagagctcgtaggtggtttgtcgcgttgttcgtgaaaaccgggggcttaaccctcggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgt

SEQ ID NO: 1304 - DNA, 1484 bp, Mycobacterium sp.
  HE5
agagtttgatcctggctcaggacgaacgctggcggcgtgcttaacacatgcaagtcgaacggaaaggcccttcggggtactcgagtggcgaacgggtgagtaacacgtgggtgatctgccctgcactttgggataagcctgggaaactgggtctaataccgaataggaccgcatgcttcatggtgtgtggtggaaagcttttgcggtgtgggatgggcccgcggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagcagggacgaagcgcaagtgacggtacctgcagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcacgttatggcggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacactcgaagccggtggcctaaccccttgtgggagggagccgtcgaaggtgggatcggcgattgggacgaagtcgtaacaaggtagccgta

SEQ ID NO: 1305 - DNA, 1470 bp, Mycobacterium sp.
  NLA001000736
agtttgatcatggttcaggacgaacgctggcggcgtgcttaacacatgcaagtcgaacggaaaggccccttcgggggtgctcgagtggcgaacgggtgagtaacacgtgggtgatctgccctgcactctgggataagcctgggaaactgggtctaataccggataggaccgcgcatcgcatggtgtgtggtggaaagcttttgcggtgtgggatgggcccgcggcctatcagcttgttggtggggttatggcctaccaaggcgacgacgggtagccggcctgagagggtgtccggccacactgggactgagatacggcccagactcctacgggaggcagcagtggggaatattgcacaatgggcggaagcctgatgcagcgacgccgcgtgagggatgacggccttcgggttgtaaacctctttcagcctcgacgaagcgcaagtgacggtaggggcagaagaagcaccggccaactacgtgccagcagccgcggtaatacgtagggtgcgagcgttgtccggaattactgggcgtaaagagctcgtaggtggtttgtcgcgtcgtccgtgaaatcccatggcttaactgtgggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgactgcagagatgtggtttcccttgtggyctgtgtacaggtggtgcatggctgtcgtcagctcgtgtcgtgagatgttgggttaagtcccgcaacgagcgcaacccttgttccatgttgccagcgcgtaatggcggggactcatgggagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggggggagctgtcgaaggtgggatcggcgattgggacgaagtcgtaac

SEQ ID NO: 1306 - DNA, 1465 bp, Mycobacterium sp.
  W
gagagtttgatcctggctcaggacgaacgctggcggcgtgcttaacacatgcaagtcgaacggaaaggccccttcgggggtactcgagtggcgaacgggtgagtaacacgtgggcaatctgccctgcacttcgggataagcctgggaaactgggtctaataccggataggacctttaggcgcatgtctttaggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaacccttgggagggagctgtcgaaggtgggatcggcg

SEQ ID NO: 1307 - DNA, 1540 bp, Mycobacterium tuberculosis
tttgtttggagagtttgatcctggctcaggacgaacgctggcggcgtgcttaacacatgcaagtcgaacggaaaggtctcttcggagatactcgagtggcgaacgggtgagtaacacgtgggtgatctgccctgcacttcgggataagcctgggaaactgggtctaataccggataggaccacgggatgcatgtcttgtggtggaaagcgctttagcggtgtgggatgagcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttctctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttaaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtcgaaggtgggatcggcgattgggacgaagtcgtaacaaggtagccgtaccggaaggtgcggctggatcacctcctttctaagg

SEQ ID NO: 1308 - DNA, 1475 bp, Mycobacterium ulcerans
ctggcggcgtgcttaacacatgcaagtcgaacggaaaggtctcttcggagatactcgagtggcgaacgggtgagtaacacgtgggcgatctgccctgcacttcgggataagcctgggaaactgggtctaataccggataggaccacgggattcatgtcctgtggtggaaagcttttgcggtgtgggatgggcccgcggcctatcagcttgttggtggggtaacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggttcgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtgcaaagggctgcgatgccgcgaggttaagcgaatcctttaacgccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaacaaggtagccgtaccggaagg

SEQ ID NO: 1309 - DNA, 1471 bp, Mycobacterium vulneris
gttcaggacgaacgctggcggcgtgcttaacacatgcaagtcgaacggaaaggcctcttcggaggtactcgagtggcgaacgggtgagtaacacgtgggcaatctgccctgcacttcgggataagcctgggaaactgggtctaataccggataggacctttagacgcatgtcttttggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggttcgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaaccttttggagggagctgtcgaaggtgggatcggcgattgggacgaagtcgtaacaa

SEQ ID NO: 1310 - DNA, 1346 bp, Mycoplasma agalactiae
gatgaacgctggctgtgtgcctaatacatgcatgtcgagcgatgatagcaatatcatagcggcgaatgggtgagtaacacgtactcaacgtaccttttagattgggatagcggatggaaacatccgataataccgaatacttattatttttgcatgaaagtaatataaaaggaagcgtttgcttcgctagaagatcggagtgcgcaacattagctagttggtgaggtaacggcccaccaaggcgatgatgtttagcggggttgagagattgatccgccacactgggactgagatacggcccagactcctacgggaggcagcagtagggaatattccacaatggacgaaagtctgatggagcgacacagcgtgcaggatgaaggccctatgggttgtaaactgctgtggttagggaagaaaaagtagcgtaggaaatgacgctaccttgacggtacctgattagaaagcaacggctaactatgtgccagcagccgcggtaatacataggttgcaagcgttatccgaaattattgggcgtaaagcgtctgtaggttgtttgttaagtctggcgttaaattttggggctcaaccccaaaacgcgttggatactggcagactagagttatgtagaggttagcggaattccttgtgaagcggtgaaatgcgtagatataaggaagaacatcaatatggcgaaggcagctaactgggcatacactgacactgagagacgaaagcgtggggagcaaacaggattagataccctggtagtccacgccctaaacgatgatcattagttgatggggaactcatcgacgcagctaacgcattaaatgatccgcctgagtagtacgttcgcaagaataaaacttaaaggaattgacggggatccgcacaagcggtggagcatgtggtttaatttgaagatacgcgtagaaccttacccactcttgacatcttctgcaaagctatggagacatagtggaggttaacagaatgacagatggtgcatggttgtcgtcagctcgtgtcgtgagatgttcggttaagtcctgcaacgagcgcaacccttatccttagttactaccatttagttgagcactctaaggagactgcccgagtaatcgggaggaaggtggggacgacgtcaaatcatcatgcctcttacgagtggggctacacacgtgctacaatggacggtacaaagagaagcgaagtggtgacatggagcaaacctcaaaaaaccgttctcagttcggattgaagtctgcaactcgacttcatgaagtcggaatcgctagtaatcgtagatcagctacgctacggtgaatacgttctcgggtctt

SEQ ID NO: 1311 - DNA, 1339 bp, Mycoplasma amphoriforme
ttgatcctggctcaggattaacgctggcggcatgcctaatacatgcaagtcgatcgagaggcgaacgggtgagtaacacgtatccaatttaccccatagcggggataactagtcgaaagattagctaataccgcataactaaagttactatgggataagggtgcggcatatcagctagttggtgaggtaacggcccaccaaggcaatgacgtgtagttatgctgagaggtagaataaccacaatggaactgagacacggtccatactcctacgggaggcagcagtagggaatttttcacaatggacgaaagtctgatggagcaatgccgcgtgaacgatgaaggtcttgtgattgtaaagttcttttatttaggaagatgaccgtactatttgaataagtaacgactaactatgtgccagcagtcgcggtaatacataggttgcaagcgttatccggatttattgggcgtaaaacaagcgcaggcggattagaaagtctggtgttaaaatcactgcttaacggttgaatgcattggaaacttctagtctagagtgtggtagagagttctggaactccatgtggagcggtggaatgcgtagatatatggaagaacaccagctgcgaaggcgagaacttaggccaactgacgcttaggcttgaaagtgtggggagcaaataggattagataccctagtagtccacaccgtaaacgatggatgttaaacgtcggggcctcggtgttgcagttaacacattaaacatcctgcctgggtagtacattcgcaagaatgaaactcaaaggaattgacggggacccgcacaagtggtggagcatgttgcttaattcgacggtacacgaaaaaccttacctagacttgacatcgacaggtggtgcatggttgtcgtcagctcgtgtcgtgagatgttgggttaagtccgcaacgcgcaacccttatcgttagttatctaacgagactgccaacgcaagttggaggaaggtggggatgacgtcaaatcatcatgccttatgtctagggctgcaaacgtgctacaatggccaacaaacagttaccaaaccgtaaggtggtgagtatctgcttggtctcagttcggatgagggctgcaattcgccctcagaagtcggaatcactagtaatcgcgaatcagctatgtcgcggtgaatacgttctcgggtcttgtacacaccgcccgtcaaactacgagagttgatagtgtctaaaaccgtgtgctaagcgcatgtctaggacaagattaatgattggagttaagtcgtaacaaggtacccctacgagaacgtgggggtggatcacctccttt

SEQ ID NO: 1312 - DNA, 1525 bp, Mycoplasma arthritidis
atatttttaagagtttgatcctggctcaggatgaacgctggctgtgtgcctaatacatgcatgtcgagcggaagtagcaatactttagcggcgaatgggtgagtaacacgtgcttaatctaccctttagactggaataactaatggaaacattggctaatgccggatgcgcatggaatcgcatgattccgttgtgaaaggagcctcaaagctccactagaggatgagggtgcggaacattagcttgttggtgaggtaacggcccaccaaggcaatgatgtttagccgggtcgagagactgaacggccacattgggactgagatacggcccaaactcctacgggaggcagcagtagggaatattccacaatgagcgaaagcttgatggagcgacacagcgtgcacgatgacggtcttcggattgtaaagtgctgttataggggaagaacacttagttgaggaaatgcttctaagctgacggtaccctgtcagaaagcgatggctaactatgtgccagcagccgcggtaatacataggtcgcaagcgttatccggaattattgggcgtaaagcgttcgtaggctgtttattaagtctggagttaaatcccagggctcaaccctggctcgctttggatactggtaaactagagttagatagaggtaagcggaattccatgtgaagcggtgaaatgcgtagatatatggaagaacaccaaaggcgaaggcagcttgctgggtctatactgacgctgagggacgaaagcgtggggagcaaacaggattagataccctggtagtccacgccgtaaacgatgatcattagtcggtggattaatcactgacgcagctaacgcattaaatgatccgcctgagtagtatgctcgcaagagtgaaacttaaaggaattgacggggacccgcacaagcggtggagcatgtggtttaatttgaagatacgcggagaaccttacccactcttgacatccttcgcaaagctatagagatatagtggaggttaacggagtgacagatggtgcatggttgtcgtcagctcgtgtcgtgagatgtttggtcaagtcctgcaacgagcgcaacccctatctttagttactaacgagtcatgtcgaggactctagagatactgcctgggtaactgggaggaaggtggggatgacgtcaaatcatcatgcctcttacgagtggggcaacacacgtgctacaatggtcggtacaaagagaagcaatatggcgacatggagcaaatctcaaaaagccgatctcagttcggattggagtctgcaattcgactccatgaagtcggaatcgctagtaatcgcagatcagctatgctgcggtgaatacgttctcgggtcttgtacacaccgcccgtcacaccatgggagctggtaatacccaaagtcggtttgctaacctcggaggcgactgcctaaggtaggactggtgactggggtgaagtcgtaacaaggtatccctacgagaacgtggggatggatcacctcctttct

SEQ ID NO: 1313 - DNA, 1474 bp, Mycoplasma bovoculi
ctcgctgtgtgcctaatacatgcatgttgaacggaatattttagcttgctaaaatatttagtagcgaatgggtgagtaacacgtacctaatctacctttaggttcgggataacttttggaaacaagagctaatacctgatatagtttattttcgcatgaagataaataaaaaggagcttcacggcttcgcctagaaatgagggtgcggaacattagttagttggtgaggtaatggctcaccaagacgatgatgtttagcggggccaagaggttgtaccgccacactgggactgagatacggcccagactcctacgggaggcagcagtaaggaattttccacaatgagcgaaagcttgatggagcgacacagcgtgcacgatgaagtctttagggatgtaaagtgctgttataaggaaagaaaaaattaaataggaaatgatttaatcttgacggtaccttattagaaagcgacggcaaactatgtgccagcagccgcggtaatacataggtcgcaagcgttatccggaattattgggcgtaaagcgtccgtaggtgttttgttaagtttaaggttaaatactgaagctcaacttcagcccgctttagatactggcaaaatagaattatgaagaggttagcggaattcctagtggagcggtggaatgcgtagatattaggaagaacaccaataggcgaaggcagctaactggtcataaattgacactaagggacgaaagcgtggggagcaaacaggattagataccctggtagtccacgctgtaaacgatgatcattagttggtggtaataatcactagcacagctaacgcgataaatgatccgcctgagtagtatgctcgcaagagtgaaacttaaaggaattgacgggaacccgcacaagcggtggagcatgtggtttaatttgaagatacgcggagaaccttacccactcttgacatccttgcaaagctatagagatatagtagaggttaacaagatgacagatggtgcatggttgtcgtcagctcgtgtcgtgagatgttaggttaagtcctgcaacgagcgcaacccctttctttagttactaacattaagttgaggactctagagacactgccagcgtaagctggaggaaggtggggatgacgtcaaatcatcatgcctcttacgagtggggcaacacacgtgctacaatggctactacaaagagaagcaaaacggtgacgtccagcaaatctcaaaaaagtagtcccagttcggattgaagtctgcaactcgacttcatgaagtcggaatcgctagtaatcgcaggtcagctatactgcggtgaatacgttctcgggttttgtacacaccgcccgtcacaccatgggagttggtaatacccaaagtcggttagttaacttcggagactgctgcctaaggtaggactgatgactggggtgaagtcgtaacaaggtatccctacgagaac

SEQ ID NO: 1314 - DNA, 1459 bp, Mycoplasma faucium
ctggctgtgtgcctaatacatgcatgtcgagcggaagtagcaatactttagcggcgaatgggtgagtaacacgtgcttaatctaccttttagattggaatacctaatggaaacattggttaatgccggatacgcatgaaatcgcatgatttcgttgtgaaaggagcgtttgctccgctaaaagatgagggtgcggaacattagctagttggtgaggtaatggcccaccaaggctatgatgtttagccgggtcgagagactgaacggccacattgggactgagatacggcccaaactcctacgggaggcagcagtagggaatattccacaatgagcgaaagcttgatggagcgacacagcgtgcacgatgaaggccctcgggttgtaaagtgctgttgcaagggaagaacacttagttgaggaaatgcaactaagctgacggtaccttgttagaaagcgatggctaactatgtgccagcagccgcggtaatacataggtcgcaagcgttatccggaattattgggcgtaaagcgttcgtaggctgtttattaagtctggagtcaaatcccagggctcaaccctggctcgctttggatactggtaaactagagttggatagaggtaagcggaattccatgtgaagcggtgaaatgcgtagatatatggaagaacaccaaaggcgaaggcagcttactgggtctatactgacgctgagggacgaaagcgtggggagcaaacaggattagataccctggtagtccacgccgtaaacgatgatcattagtcggtgggagccactgacgcagctaacgcattaaatgatccgcctgagtagtatgctcgcaagagtgaaacttaaaggaattgacggggacccgcacaagcggtggagcatgtggtttaatttgaagatacgcggagaaccttacccactcttgacatcctttgcaaagctatagagatatagtggaggttaacagagtgacagatggtgcatggttgtcgtcagctcgtgtcgtgagatgtttggtcaagtcctgcaacgagcgcaacccctatctttagttactaacgagtcatgttgaggactctagagatactgcctgggtaactgggaggaaggtggggatgacgtcaaatcatcatgcctcttacgagtggggcaacacacgtgctacaatggtcggtacaaagagacgcaatacggtgacgtggagcaaatctcaaaaagccgatctcagttcggattgaagtctgcaattcgacttcatgaagtcggaatcgctagtaatcgcagatcagctatgctgcggtgaatacgttctcgggtcttgtacacaccgcccgtcacaccatgggagctggtaatacccaaagtcggtttgctaacctcggaggcgactgcctaaggtaggactggtgactggggtgaagtcgtaacaaggtatccctacgagaa

SEQ ID NO: 1315 - DNA, 1517 bp, Mycoplasma fermentans
attttttcgagagtttgatcctggctcaggatgaacgctggctgtgtgcctaatacatgcatgtcgagcgaaggtagcaataccttagcggcgaatgggtgagtaacacgtgctcaacgtacccttcagtttggcatagcgactggaaacagtcgataatttcaaatactcgtagttttcgcatgaagattacggaaaagaagcgtttgcttcgctggaggagcggggtgcgtaacattagctagttggtgaggtaacggcccaccaaggcgatgatgtttagcggggttgagagactgaaccgccacactgggactgagatacggcccagactcctacgggaggcagcagtagggaatattccacaatgggcgaaagcctgatggagcgacacagcgtgaaggatgaaggtcctatggattgtaaacttctgtggtaagggaagaaaagacagaataggaaatgattttgttttgacggtaccttattagaaagcaacggctaactatgtgccagcagccgcggtaatacataggttgcaagcgttatccggaattattgggcgtaaagcgtctgtaggttgtttgttaagtctggcgttaaattttggggctcaaccccaaaacgcgttggatactggcaggctagagttgtgtagaggttagcggaattccttgtgaagcggtgaaatgcgtagatataaggaagaacaccaagatggcgaaggcagctaactggacatatactgacactgagagacgaaagcgtggggagcaaacaggattagataccctggtagtccacgccctaaacgatgatcattagctgatggggaactcatcggcgcagctaacgcattaaatgatccgcctgagtagtacgttcgcaagaataaaacttaaaggaattgacggggatccgcacaagcggtggagcatgtggtttaatttgaagatacgcgtagaaccttacccactcttgacatcttctgcaaagctatggagacatagtggaggttaacagaatgacagatggtgcatggttgtcgtcagctcgtgtcgtgagatgtttggttaagtcctgcaacgagcgcaacccttatccttagttactaccattcagttgaggactctaaggagactgcccgagtaatcgggaggaaggtggggatgacgtcaaatcatcatgcctcttacgagtggggcaacacacgtgctacaatggccggtacaaagagaagcgaagtggtgacatggagcaaacctcaaaaaaccggtctcagttcggattgtagtctgcaactcgactacatgaagtcggaatcgctagtaatcgtagatcagctacgctacggtgaatacgttctcgggtcttgtacacaccgcccgtcaaaccatgggagctggtaatgcccgaagtcggtttataaacaaactgcctaaggcaggactggtgactggggttaagtcgtaacaaggtatccctacgagaacgtggggatggatcacctcctttct

SEQ ID NO: 1316 - DNA, 1545 bp, Mycoplasma flocculare
gcaatcatgagagtttgatcctagctcaggatgaacgctagctgtgtgcttaatacatgcatttgaacgggatagtattttagttttactaaagtattgttttagtagcaaatgggtgagtaacacgtacctaacctaccttttggactgggataaccattggaaacagtggctaataccggatataataaaaattcacatgaatttttatgaaaaggagcgaaaataagctccaccaaaaaatgggggtgcgcaacattagttagttggtagggtaaaggcctaccaagacgatgatgtttagcggggccaagaggttgtaccgccacactgggattgagatacggcccagactcctacgggaggcagcagtaaggaatattccacaatgagcgaaagcttgatggagcgacacagcgtgcaggatgaagtctttaggtatgtaaactgctgttgtaagggaagaaaaaaattaggtagggaatgatctaatcttgacggtaccttactagaaagcgacggcaaactatgtgccagcagccgcggtaatacataggtcgcaagcgttatccggaattattgggcgtaaagcgttcgtaggttttttgttaagtttaaggttaaatgctaaagctcaactttagtccgctttagatactggcaaaatagaattatgaagaggttagcggaattcctagtggagtggtggaatacgtagatattaggaagaacaccaataggcgaaggcagctaactggtcatatattgacactgagggacgaaagcgtggggagcaaacaggattagataccctggtagtccacgccgtaaacgatgatcattagttggtggcagaagtcactagcgcagctaacgcgttaaatgatccgcctgagtagtatgctcgcaagagtgaaacttaaaggaattgacgggaacccgcacaagcggtggagcatgtggtttaatttgaggatacgcgtagaaccttacccactcttgacattctcgcaaaactatagagatatagcggaggctaacgagattacagatggtgcatggttgtcgtcagctcgtgtcgtgagatgttaggttaagtcctgcaacgagcgcaacccttttctttagttgctaacattaagttgagaaccctagagatactgccggtgtaaaccggaggaaggtggggatgacgtcaaatcatcatgcctcttacgagtggggcaacacacgtgctacaatggctactacaaagagcagcaaaacagtgatgtcaagctaatctcaaaaaagtagtctcagttcggattgaagtctgcaactcgacttcatgaagtcggaatcgctagtaatcgcaggtcagctatactgcggtgaatacgttctcgggttttgtacacaccgcccgtcacaccatgggagttggtaatgcccaaagtcggtgagttaacctcggagaccattgcctaaggcaggaccgatgactggggtgaagtcgtaacaaggtatccctacgagaacgtggggatggaacacctcctttct

SEQ ID NO: 1317 - DNA, 1521 bp, Mycoplasma genitalium
ttttttctgagagtttgatcctggctcaggattaacgctggcggcatgcctaatacatgcaagtcgatcggaagtagcaatactttagaggcgaacgggtgagtaacacgtatccaatctaccttataatgggggataactagttgaaaaactagctaataccgcataagaactttagttcgcatgaattaaagttgaaaggacctgcaagggttcgttatttgatgagggtgcgccatatcagctagttggtagggtaatggcctaccaaggcaatgacgtgtagctatgctgagaagtagaatagccacaatgggactgagacacggcccatactcctacgggaggcagcagtagggaatttttcacaatgagcgaaagcttgatggagcaatgccgcgtgaacgatgaaggtctttttgattgtaaagttcttttatttgggaagaatgactctagcaggcaatggctggagtttgactgtaccactttgaataagtgacgactaactatgtgccagcagtcgcggtaatacataggtcgcaagcgttatccggatttattgggcgtaaagcaagcgcaggcggattgaaaagtctggtgttaaaggcagctgcttaacagttgtatgcattggaaactatcagtctagagtgtggtagggagttttggaatttcatgtggagcggtgaaatgcgtagatatatgaaggaacaccagtggcgaaggcgaaaacttaggccattactgacgcttaggcttgaaagtgtggggagcaaataggattagataccctagtagtccacaccgtaaacgatagatactagctgtcggagcgatcccttcggtagtgaagttaacacattaagtatctcgcctgggtagtacattcgcaagaatgaaactcaaacggaattgacggggacccgcacaagtggtggagcatgttgcttaattcgacggtacacgaaaaaccttacctagacttgacatccttggcaaagttatggaaacataatggaggttaaccgagtgacaggtggtgcatggttgtcgtcagctcgtgtcgtgagatgttgggttaagtcccgcaacgagcgcaacccttatcgttagttacattgtttaacgagactgctaatgtaaattggaggaaggaagggatgacgtcaaatcatcatgccccttatgtctagggctgcaaacgtgctacaatggccaatacaaacagtagccaacttgtaaaagtgagcaaatctgaaaagttggtctcagttcggattgagggctgcaattcgtcctcatgaagctggaatcactagtaatcgcgaatcagctatgtcgcggtgaatacgttctcgggtcttgtacacaccgcccgtcaaactatgaaagctggtaatatttaaaaacgtgttgctaacctttattggaagcgcatgtcaaggatagcaccggtgattggagttaagtcgtaacaaggtacccctacgagaacgtgggggtggatcacctcctttc

SEQ ID NO: 1318 - DNA, 1521 bp, Mycoplasma hominis
tttttataagagtttgatcctggctcaggatgaacgctggctgtgtgcctaatacatgcatgtcgagcgaggttagcaataacctagcggcgaatgggtgagtaacacgtgcttaatctaccttttagattggaatacccattggaaacaatggctaatgccggatacgcatggaaccgcatggttccgttgtgaaaggcgctgtaaggcgccactaaaagatgagggtgcggaacattagttagttggtgaggtaatggcccaccaagactatgatgtttagccgggtcgagagactgaacggccacattgggactgagatacggcccaaactcctacgggaggcagcagtagggaatattccacaatgagcgaaagcttgatggagcgacacagcgtgcacgatgaaggtcttcggattgtaaagtgctgttataagggaagaacatttgcaataggaaatgattgcagactgacggtaccttgtcagaaagcgatggctaactatgtgccagcagccgcggtaatacataggtcgcaagcgttatccggaattattgggcgtaaagcgttcgtaggctgtttgttaagtctggagttaaatcccggggctcaaccccggctcgctttggatactagcaaactagagttagatagaggtaagcggaattccatgtgaagcggtgaaatgcgtagatatatggaagaacaccaaaggcgaaggcagcttactgggtctatactgacgctgagggacgaaagcgtggggagcaaacaggattagataccctggtagtccacgccgtaaacgatgatcattagtcggtggagaatcactgacgcagctaacgcattaaatgatccgcctgagtagtatgctcgcaagagtgaaacttaaaggaattgacggggacccgcacaagcggtggagcatgtggtttaatttgaagatacacggaaaaccttacccactcttgacatccttcgcaaagctatagagatatagtggaggttatcggagtgacagatggtgcatggttgtcgtcagctcgtgtcgtgagatgtttggtcaagtcctgcaacgagcgcaacccctatctttagttactaacattaagttgaggactctagagatactgcctgggtaactgggaggaaggtggggatgacgtcaaatcatcatgcctcttacgagtggggccacacacgtgctacaatggtcggtacaaagagaagcaatatggcgacatggagcaaatctcaaaaagccgatctcagttcggattggagtctgcaattcgactccatgaagtcggaatcgctagtaatcgcagatcagctatgctgcggtgaatacgttctcgggtcttgtacacaccgcccgtcacaccatgggagctggtaatacccaaagtcggtttgctaacctcggaggcgaccgcctaaggtaggactggtgactggggtgaagtcgtaacaaggtatccctacgagaacgtggggatggatcacctcctttct

SEQ ID NO: 1319 - DNA, 1510 bp, Mycoplasma orale
agagtttgatcctggctcaggatgaacgctggctgtgtgcctaatacatgcatgtcgagcggaagtagcaatactttagcggcgaatgggtgagtaacacgtgcttaatctaccttttagattggaatacctaatggaaacattggttaatgccggatacgcatgaagtcgcatgacttcgttgtgaaaggagcgtttgctccgctaagagatgagggtgcggaacattagctagttggtgaggtaatggcccaccaaggctatgatgtttagccgggtcgagagactgaacggccacattgggactgagatacggcccaaactcctacgggaggcagcagtagggaatattccacaatgagcgaaagcttgatggagcgacacagcgtgcacgatgaaggccctcgggttgtaaagtgctgttgcaagggaagaacagttagttgaggaaatgcttctaatctgacggtaccttgttagaaagcgacggctaactatgtgccagcagccgcggtaatacataggtcgcaagcgttatccggaattattgggcgtaaagcgttcgtaggctgtttattaagtctggagtcaaatcccagggctcaaccctggctcgctttggatactggtaaactagagttagatagaggtaagcggaattccatgtggagcggtgaaatgcgtagatatatggaagaacaccaaaggcgaaggcagcttactgggtctatactgacgctgagggacgaaagcgtggggagcaaacaggattagataccctggtagtccacgctgtaaacgatgatcattagtcggtggaaaactactgacgcagctaacgcattaaatgatccgcctgagtagtatgctcgcaagagtgaaacttaaaggaattgacggggacccgcacaagcggtggagcatgtggtttaatttgaagatacgcggagaaccttacccactcttgacatcccctgcaaagctatagagatatagtagaggttaacagggtgacagatggtgcatggttgtcgtcagctcgtgtcgtgagatgtttggtcaagtcctgcaacgagcgcaacccctatctttagttactaacgagtcatgtcgaggactctagagatactgcctgggtaaccgggaggaaggtggggatgacgtcaaatcatcatgcctcttacgagtggggctacacacgtgctacaatggtcggtacaaagagaagcaatatggcgacatggagcaaatctcaaaaagccgatctcagttcggattgaagtctgcaattcgacttcatgaagtcggaatcgctagtaatcgcagatcagctacgctgcggtgaatacgttctcgggtcttgtacacaccgcccgtcacaccatgggagctggtaatacccaaagtcggtttgctaacctcggaggcgactgcctaaggtaggactggtgactggggtgaagtcgtaacaaggtatccctacgagaacgtgcggctggatcacctcctt

SEQ ID NO: 1320 - DNA, 1475 bp, Mycoplasma ovipneumoniae
ctatctgtgtgcttaatacatgcatgttgaacggaatatgttagcttgctaatatatttagtagcaaatgggtgagtaacacgtacctaacctaccttttggaccgggataaccattggaaacagcggctaataccagatacgataaaaaaatgcatgtttttttattaaaagaagcctttaaagcttcaccaaaaaatgggggtgcgcaacattagttagttggtagggtaaaggcctaccaagacgatgatgtttagcggggccaagaggctgtaccgccacactgggattgagatacggcccagactcctacgggaggcagcagtaaggaatattccacaatgagcgaaagcttgatggagcgacacagagtgcaggatgaagtctttagggatgtaaactgctgttgtaagggaagaaaaaactagataggaaatgatttagtcttgacggtaccttattagaaagtgacggcaaactatgtgccagcagccgcggtaatacataggtcgcaagcgttatccggaattattgggcgtaaagcgtccgcaggttttttgttaagtttaaggttaaatgctaaagctcaactttagttcgctttagatactgacaaaatagaattatgaagaggttagcggaattcctagtggagcggtggaatgcgtagatattaggaagaacaccaataggcgaaggcagctaactggtcatatattgacactaatggacgaaagcgtggggagcaaacaggattagataccctggtagtccacgccgtaaacgatgatcattagttggtggcaaaagtcactagcacagctaacgcgttaaatgatccgcctgagtagtatgctcgcaagagtgaaacttaaaggaattgacgggaacccgcacaagcggtggagcatgtggtttaatttgaagatacgcgtagaaccttacccactcttgacatcctcgcaaaactatagagatatagcggaggctaacgagatgacagatggtgcatggttgtcgtcagctcgtgtcgtgagatgttaggttaagtcctgcaacgagcgcaacccttttctttagttgctaacattaagttgagaaccctagagatactgccggtgcaaaccggaggaaggcggggatgacgtcaaatcatcatgcctcttacgagtggggcaacacacgtgctacaatggctactacaaagagcagcgaaacagtgatgtcaagctaatctcaaaaaagtagtctcagttcggattgaagtctgcaactcgacttcatgaagtcggaatcgctagtaatcgcaggtcagctatactgcggtgaatacgttctcgggttttgtacacaccgcccgtcacaccatgggagttggtaatgcccaaagtcggtgagttaacctcggagaccattacctaaggcaggaccgatgactggggtgaagtcgtaacaaggtatccctacgagaac

SEQ ID NO: 1321 - DNA, 1516 bp, Mycoplasma penetrans
tcaattttaagagtttgatcctggctcaggattaacgctagcgggatgcctaatacatgcaagtcggacgaagcacttgtgcttagtggcgaacgggtgagtaacacgtatctaacataccttttagtgggggataactggttgaaaaactagctaataccgcataggacattactatcgcatgagaaaatgtttaaagttgcgtttgcaacgctttaagattgaggtgtggcatatcagatagttggtagggtaacggcctaccaagtctatgacgtgtagctgtgctgagaggcaaaacagccacaatggaactgagacacggtccatacttctacgggaggcagcagtagggaatttttcacaatgggcgcaagcctgatggagcaatcccgcgtgaacgacgaaggttttttaaattgtaaagttcttttattggggacgaattgtaagaagaggaaatgctttttatttgactgtaccctttgaataagtatcggctaactatgtgccagcagccgcggtaatacataggatgcaagcgttatccggatttactgggcgtaaagcgagcgcaggcggatttacaagtctggtgttaaatatagctgcccaacagttatatgcattggaaactgtaagtctagagtgcagtagagagttttggaactccatgtggagcggtggaatgcgtagatatatggaagaacaccagaggcgaaggcgaaaacttaggctgttactgacgcttaggctcgaaagtgtggggagcaaataggattagataccctagtagtccacaccgtaaacgatggtaattaaatcttggtacgggatgtatcaggattgcagttaacacattaaattacccgcctgggtagtacattcgcaagaatgaaactcaaacggaattgacggggacccgcacaagtggtggagcatgttgcttaattcgacgatacacgtaaaaccttacctgggtttgacatcctctgcaaagctatagagatatagtggaggttaacagagtgacaggtggtgcatggttgtcgtcagctcgtgtcgtgagatgttgggttaagtcccgcaacgagcgcaacccttatcgttagttacttcatctagcgagactgccagcgtaagctggaggaaggtggggatgacgtcaaatcatcatgccctttatatccagggccgcaaacgtgctacaatggtcggtacaaactgttgccaatcagcaatgaggagctaatcagagaaagccgatctcagttcggatcgagggctgcaattcgtcctcgtgaagttggaatcactagtaatcgcaaatcagccatgttgcggtgaatacgttctcgggtcttgtacacaccgcccgtcaaactatgagagctggtaatacctaaaaccgttaagctaacctcgtgaggcttgcgtctagggtaggactggtaattggagttaagtcgtaacaaggtacccctacgggaatgtgggggtggatcacctcctttct

SEQ ID NO: 1322 - DNA, 1559 bp, Mycoplasma pneumoniae
tgttctttcaaaactggatgcaatctgtcaatttttctgagagtttgatcctggctcaggattaacgctggcggcatgcctaatacatgcaagtcgatcgaaagtagtaatactttagaggcgaacgggtgagtaacacgtatccaatctaccttataatgggggataactagttgaaagactagctaataccgcataagaactttggttcgcatgaatcaaagttgaaaggacctgcaagggttcgttatttgatgagggtgcgccatatcagctagttggtggggtaacggcctaccaaggcaatgacgtgtagctatgctgagaagtagaatagccacaatgggactgagacacggcccatactcctacgggaggcagcagtagggaatttttcacaatgagcgaaagcttgatggagcaatgccgcgtgaacgatgaaggtctttaagattgtaaagttcttttatttgggaagaatgactttagcaggtaatggctagagtttgactgtaccattttgaataagtgacgactaactatgtgccagcagtcgcggtaatacataggtcgcaagcgttatccggatttattgggcgtaaagcaagcgcaggcggattgaaaagtctggtgttaaaggcagctgcttaacagttgtatgcattggaaactattaatctagagtgtggtagggagttttggaatttcatgtggagcggtgaaatgcgtagatatatgaaggaacaccagtggcgaaggcgaaaacttaggccattactgacgcttaggcttgaaagtgtggggagcaaataggattagataccctagtagtccacaccgtaaacgatagatactagctgtcggggcgatcccctcggtagtgaagttaacacattaagtatctcgcctgggtagtacattcgcaagaatgaaactcaaacggaattgacggggacccgcacaagtggtggagcatgttgcttaattcgacggtacacgaaaaaccttacctagacttgacatccttggcaaagttatggaaacataatggaggttaaccgagtgacaggtggtgcatggttgtcgtcagctcgtgtcgtgagatgttgggttaagtcccgcaacgagcgcaacccttatcgttagttacattgtctagcgagactgctaatgcaaattggaggaaggaagggatgacgtcaaatcatcatgccccttatgtctagggctgcaaacgtgctacaatggccaatacaaacagtcgccagcttgtaaaagtgagcaaatctgtaaagttggtctcagttcggattgagggctgcaattcgtcctcatgaagtcggaatcactagtaatcgcgaatcagctatgtcgcggtgaatacgttctcgggtcttgtacacaccgcccgtcaaactatgaaagctggtaatatttaaaaacgtgttgctaaccattaggaagcgcatgtcaaggatagcaccggtgattggagttaagtcgtaacaaggtacccctacgagaacgtgggggtggatcacctcctttctaatggagtt

SEQ ID NO: 1323 - DNA, 1466 bp, Mycoplasma putrefaciens
ctggcggcatgcctaatacatgcaagtcgaacgggggtgcttgcaccccagtggcgaacgggtgagtaacacgtatctaacctaccttatagcgggggataacttttggaaacgaaagataataccgcatgtgaatcttattatcgcatgagaaaagattgaaagaaccgtttggttcactatgagatggggatgcggcgtattagctagtaggtgaggtaatggctcacctaggcgatgatacgtagccgaactgagaggttgatcggccacattgggactgagatacggcccagactcctacgggaggcagcagtagggaatttttcacaatggacgaaagtctgatgaagcaatgccgcgtgagtgatgacggccttcgggttgtaaagctctgttgtaagggaagaaaaaataaagtaggaaatgcctttatattgacggtaccttaccagaaagccacggctaactatgtgccagcagccgcggtaatacataggtggcaagcgttatccggatttattgggcgtatagggtgcgtaggcggttgtgcaagtttgaggttaaagtccggagctcaactccggttcgccttgaaaactgcattactagaatacaagagaggtaagcggaattccatgtgtagcggtgaaatgcgtagatatatggaagaacacctgtggcgaaagcggcttactggtttgttattgacgctgaggcacgaaagcgtggggagcaaataggattagataccctagtagtccacgccgtaaacgatgagtactaggtgttgggtgaactcagcgccgcagctaacgcattaagtactccgcctgagtagtatgctcgcaagagtgaaactcaaaggaattgacggggacccgcacaagtggtggagcatgtggtttaattcgaagcaacacgaagaaccttaccagggcttgacatccagtgcaaagctatagagatatagtagaggttaacattgagacaggtggtgcatggttgtcgtcagttcgtgccgtgaggtgttgggttaagtcccgcaacgaacgcaacccttgtcgttagttactaacattaagttgaggactctaacgagactgctagtgtaagctagaggaaggtggggatgacgtcaaatcatcatgccccttatgtcctgggctacacacgtgctacaatggctggtacaaagagtcgcaatctcgcgagggggagctaatctcaaaaaaccagtctcagttcggattgaagtctgcaactcgacttcatgaagccggaatcactagtaatcgcgaatcagctatgtcgcggtgaatacgttctcgggtcttgtacacaccgcccgtcacaccacgagagttggtaataccagaagtgggtagcttaaccgcaaggagagcgcctcccaaggtaggactagcgattggggtgaagtcgtaacaaggtatccgtacgggaac

SEQ ID NO: 1324 - DNA, 1474 bp, Mycoplasma salivarium
  modified_base (152)..(152): a, c, t, g, unknown or other
  modified_base (188)..(188): a, c, t, g, unknown or other
  modified_base (329)..(330): a, c, t, g, unknown or other
  modified_base (486)..(486): a, c, t, g, unknown or other
  modified_base (541)..(541): a, c, t, g, unknown or other
  modified_base (553)..(554): a, c, t, g, unknown or other
  modified_base (760)..(760): a, c, t, g, unknown or other
  modified_base (890)..(891): a, c, t, g, unknown or other
  modified_base (896)..(952): a, c, t, g, unknown or other
  modified_base (1041)..(1041): a, c, t, g, unknown or other
  modified_base (1168)..(1168): a, c, t, g, unknown or other
  modified_base (1437)..(1437): a, c, t, g, unknown or other
  modified_base (1439)..(1439): a, c, t, g, unknown or other
  modified_base (1470)..(1470): a, c, t, g, unknown or other
aattttaagagtttgatcctggctcaggatgaacgctggctgtgtgcctaatacatgcatgtcgagcggaagtagcaatactttagcggcgaatgggtgagtaacacgtgcttaatctacctcttagattggaatacctaatggaaacattngttaatgccggatacgcatggagtcgcatgactccnttgtgaaaggggcctttaaagctccactaagagatgagggtgcggaacattagctagttggtgaggtaacggcccaccaaggctatgatgtttagccgggtcgagagactgaacggccacattgggactgagatacggccnnaactcctacgggaggcagcagtagggaatattccacaatgagcgaaagcttgatggagcgacacagcgtgcacgatgaaggtcttatggattgtaaagtgctgttgctagggaagaaaaagtagttgaggaaatgcttctacattgacggtacctngttagaaagcgatggctaactatgtgccagcagccgcggtaatacataggtcgcnagcgttatccgnnattattgggcgtaaagcgttcgtaggctgtttattaagtctggagtcaaatcccagggctcaaccctggctcgctttggatactggtaaactagagttggatagaggtaagcggaattccatgtgaagcggtgaaatgcgtagatatatggaagaacaccaaaggcgaaggcagcttactgggtttatactgacgctgaggaacgnaagcgtggggagcaaacaggattagataccctggtagtccacgccgtaaacgatgatcattagtcggcagagaactgttgacgcagctaacgcattaaatgatccgcctgagtagtatgctcgcaagagnnaaacnnnnnnnnnnnnnnnnnnnnnnnnnnnnnnnnnnnnnnnnnnnnnnnnnnnnnnnnntacgcggagaaccttacccactcttgacatccttcgcaaagctatagagatatagtggaggttaacggagtgacagatggtgcatggtngtcgtcagctcgtgtcgtgagatgtttggtcaagtcctgcaacgagcgcaacccctatctttagttactaacgagtcatgtcgaggactctagagatactgcctgggtaactgggaggaaggtgggnatgacgtcaaatcatcatgcctcttacgagtggggcaacacacgtgctacaatggtcggtacaaagagaagcaatatggcgacatggagcaaatctcaaaaagccgatctcagttcggattgaagtctgcaattcgacttcatgaagtcggaatcgctagtaatcgcagatcagctatgctgcggtgaatacgttctcgggtcttgtacacaccgcccgtcacaccatgggagctggtaatacccaaagtcggtttgctaaccgtccgngnaggcgactgcctaaggtaggactggtgactngggt

SEQ ID NO: 1325 - DNA, 1290 bp, Mycoplasmataceae sp.
  P1 oral clone MB1_G23
gattaacgctggcggtacgtctaatacatgcaagtcgaacgagtggcgaacgggtgagtaacacgtaggtaacctgcctacaagttggggataacacaaggaaacttgtgctaataccgaataattaaagctgcttgaagaggggcctgcggcgcattagttagttggtaaggtaatggcttaccaagacgatgatgcgtagctggactgagaggttgaacagccacattgggactgagaaacggcccagactcctacgggaggcagcagtagagaatcttcggcaatgggggaaaccctgaccgagcgataccgcgtgagtgatgaaatacttcggtatgtaaaattcttttattaaagaagatgacgttatttaatgaataagtcccggctaactatgtgccagcagccgcggtaatacataggggacgagcgttatccggaataattgggcgtaaagggtgcgtaggcggtgtgttaagttcaaggtttaatcgtagggctcaaccctatatcgctttgaaaactggcacactagagtaagatagaggcaagtggaattccatgtgtagcggtaaaatgcgtaaatatatggcagaacaccagaggcgaaggcggcttgctgggtctaccgacgctgaggcacgaaagcgtggggagcaaacaggattagataccctggtagtccacgccgtaaacgatgagcactaaaagtcgggttcggctttcaagttaacgcgataagtgctccgcctgagtagtacgtacgcaagtataaaactcaaaggaattggcgggacctcgcacaagcggtggatcatgttgtttaattcgttgatacgcgatgaaccttaccaggccttgacatatacaggtggtgcatggttgtcgtcagctcgtgtcgtgagatgttaggttaagtcctgcaacgagcgcaactcttattgctatttgccatcatgggcactatagtgagactgccagtgataaactggaggaaggtgggaatgacgtcaaatcatcatgccccttatggcctgggccacaaacgtgatacaatggttgtcaaaaggatgctagaaagtgattttaggcaaatccttacaatctcagttcggatgaagtctgcaactcgacttcagaagtcggaatcgctagtaatcgtagatcagaacgctacggtgaatacgttctcgaggtttgcacacaccgcccgtcaaaccacgaaagttaacaatacccaaaaccggtgcctaaggagccgtctaaggtagggttaatgattggggt

SEQ ID NO: 1326 - DNA, 1484 bp, Myroides odoratimimus
agcggcaggcctaacacatgcaagtcgaggggtagaaagagcttgcttttttgagaccggcgcacgggtgagtaacgcgtatgcaacctaccttatacaggggaatagcccgaagaaattcggattaatgctccatggtttatcgatatggcatcgtattgataataaagatttatcggtataagatgggcatgcgtatcattagctagttggtgtggtaacggcataccaaggcaacgatgattaggggtcctgagagggagatcccccacactggtactgagacacggaccagactcctacgggaggcagcagtgaggaatattggtcaatggaggcaactctgaaccagccatgccgcgtgcaggatgacggtcctatggattgtaaactgcttttgtacaggaagaaacctccctacgagtagggacttgacggtactgtaagaataaggatcggctaactccgtgccagcagccgcggtaatacggaggatccgagcgttatccggaattattgggtttaaagggttcgtaggcggctttgtaagtcagtggtgaaatttcctagcttaactaggacactgccattgatactgcagagcttgaataatatggaagtaactagaatatgtagtgtagcggtgaaatgcttagatattacatggaataccaattgcgaaggcaggttactacgtatttattgacgctgatgaacgaaagcgtggggagcgaacaggattagataccctggtagtccacgccgtaaacgatggatactagctgttcggttttcggactgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgtagattgacagatttggaaacagatttttcttcggacaatttacaaggtgctgcatggttgtcgtcagctcgtgccgtgaggtgtcaggttaagtcctataacgagcgcaacccctattgttagttaccagcgcgtagaggcggggactctagcaagactgccggtgcaaaccgtgaggaaggtggggatgacgtcaaatcatcacggcccttacgtcctgggctacacacgtgctacaatggcaagtacagaaagcagctacctggcaacaggatgcgaatctccaaagcttgtctcagttcggattggagtctgcaactcgactctatgaagctggaatcgctagtaatcggatatcagccatgatccggtgaatacgttcccgggccttgtacacaccgcccgtcaagccatggaagctgggggtacctgaagtcggtgaccgcaaggagctgcctagggtaaaactagtaactagggctaagtcgtaacaaggtagccgtaccggaaggtgcggctggatcacctcctttcta

SEQ ID NO: 1327 - DNA, 1481 bp, Myroides sp.
  MY15
agagtttgatcctggctcaggatgaacgctagcggcaggcctaacacatgcaagtcgaggggtatattgagcttgcttaatagagaccggcgcacgggtgagtaacgcgtatgcaacctaccttctacaggggaatagcccgaagaaattcggattaatgctccatggtttaattgaatggcatcatttaattaataaagatttatcggtagaagatgggcatgcgtatcattagctagttggtgtggtaacggcataccaaggcgacgatgattaggggtcctgagagggagatcccccacactggtactgagacacggaccagactcctacgggaggcagcagtgaggaatattggtcaatggaggcaactctgaaccagccatgccgcgtgcaggatgacggtcctatggattgtaaactgcttttgtacaggaagaaacctcgctacgagtagcgatttgacggtactgtaagaataaggatcggctaactccgtgccagcagccgcggtaatacggaggatccgagcgttatccggaattattgggtttaaagggttcgtaggcggttggataagtcagtggtgaaatttcttagcttaactaagacccggccattgatactgtttgacttgaatagtatggaagtaactagaatatgtagtgtagcggtgaaatgcttagatattacatggaataccaattgcgaaggcagggttactacgtacttattgacgctgatgaacgaaagcgtggggagcgaacaggattagataccctggtagtccacgccgtaaacgatggatactagctgttcggttttcggactgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgtagattgacaggtttggaaacagacttttcttcggacaatttacaaggtgctgcatggttgtcgtcagctcgtgccgtgaggtgtcaggttaagtcctataacgagcgcaacccctattgttagttaccatcgagtaatgtcgggaactctagcaagactgccggtgcaaaccgtgaggaaggtggggatgacgtcaaatcatcacggcccttacgtcctgggctacacacgtgctacaatggtcagtacagaaagcagctacctggcgacaggatgcgaatctcaaaagctgatcacagttcggattggagtctgcaactcgactccatgaagctggaatcgctagtaatcggatatcagccatgatccggtgaatacgttcccgggccttgtacacaccgcccgtcaagccatggaagctgggggtacctgaagtcggtgaccgcaaggagctgcctagggtaaaactagtaactagggctaagtcgtaacaaggtaacca

SEQ ID NO: 1328 - DNA, 1545 bp, Neisseria bacilliformis
ttgaacataagagtttgatcctggctcagattgaacgctggcggcatgctttacacatgcaagtcggacggcagcacagagaagcttgcttcttgggtggcgagtggcgaacgggtgagtaacgcatcggaacgtaccgagtaatgggggataactgtccgaaaggacagctaataccgcatacgccctgagggggaaagcgggggatcttaggacctcgcgttattcgagcggccgatgtctgattagctggttggcggggtaaaggcccaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggggcatgttaataccgtgctctgatgacggtacctgaagaataagcaccggctaactacgtgccagcagccgcggtaatacgtagggtgcgagcgttaatcggaattactgggcgtaaagcgggcgcagacggttacttaagcgggatgtgaaatccccgggctcaacccgggaactgcgttccgaactgggtggctagagtgtgtcagaggggggtagaattccacgtgtagcagtgaaatgcgtagagatgtggaggaataccgatggcgaaggcagccccctgggataacactgacgttcatgcccgaaagcgtgggtagcaaacaggattagataccctggtagtccacgccctaaacgatgtcgattagctgttggggcacttgatgccttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccttccagagacggaagggtgccttcgggagccgtaacacaggtgctgcatggctgtcgtcagctcgtgtcgtgagatgttgggttaagtcccgcaacgagcgcaacccttgtcattagttgccatcatttggttgggcactctaatgagactgccggtgacaaaccggaggaaggtggggatgacgtcaagtcctcatggcccttatgaccagggcttcacacgtcatacaatggtcggtacagagggtagccaagccgcgaggcggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagcaggtaggctaaccgcaagggggccgcttgccacggtatgcttcatgactggggtgaagtcgtaacaaggtagccgtaggggaacctgcggctggatcacctcctttct

SEQ ID NO: 1329 - DNA, 1549 bp, Neisseria cinerea
tgaacataagagtttgatcctggctcagattgaacgctggcggcatgctttacacatgcaagtcggacggcagcacagagaagcttgcttcttgggtggcgagtggcgaacgggtgagtaacatatcggaacgtaccgagtagtgggggataactgatcgaaagatcagctaataccgcatacgtcttgagagggaaagcaggggaccttcgggccttgcgctattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgctcgaaagcgtgggtagcaaacaggattagataccctggtagtccacgccctaaacgatgtcaattagctgttgggcaacttgattgttcagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccgcaaggggtccgcttaccacggtatgcttcatgactggggtgaagtcgtaacaaggtagccgtaggggaacctgcggctggatcacctcctttctagaga

SEQ ID NO: 1330 - DNA, 1544 bp, Neisseria elongata
ttgaacataagagtttgatcctggctcagattgaacgctggcggcatgctttacacatgcaagtcggacggcagcggggtagtgcttgcactactgccggcgagtggcgaacgggtgagtaatatattggaacgtaccgagtaatgggggataaccaatcgaaagattggctaataccgcatacgctctgaggaggaaagcaggggaccttcgggccttgcgttattcgagcggccaatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgttagggaagaaaaggaacggttaatacccgtttctgctgacggtacctaaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtagctagagtatgtcagaggggggtagaattccacgtgtagcagtgaaatgcgtagagatgtggaggaataccgatggcgaaggcagccccctgggataatactgacgttcatgctcgaaagcgtgggtagcaaacaggattagataccctggtagtccacgccctaaacgatgtcgattagctgttgggcagcttgactgcttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccttccagagacggaagggtgccttcgggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaaaccggaggaaggtggggatgacgtcaagtcctcatggcccttatgaccagggcttcacacgtcatacaatggtcggtacaaagggtagccaagccgcgaggcggagccaatctcataaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgtaaggagcccgcttaccacggtatgcttcatgactggggtgaagtcgtaacaaggtagccgtaggggaacctgcggctggatcacctcctttct

SEQ ID NO: 1331 - DNA, 1549 bp, Neisseria flavescens
tgaacataagagtttgatcctggctcagattgaacgctggcggcatgctttacacatgcaagtcggacggcagcacagagaagcttgcttcttgggtggcgagtggcgaacgggtgagtaatatatcggaacgtaccgagtaatgggggataactaatcgaaagattagctaataccgcatattctctgaggaggaaagcaggggaccttcgggccttgcgttattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcgacagctgatgacggtacctgaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctagaga

SEQ ID NO: 1332 - DNA, 1278 bp, Neisseria sp.
  P2 oral clone MB5_P15
attgaacgctggcggcatgctttacacatgcaagtcgaacgagtggcgaacgggtgagtaacatattggaacgtaccgagtagtgggggataactaatcgaaagattagctaataccgcatacggaaagacgctatttgagcggccaatatcggattagctagttggtggggtaaaggcctaccaaggcgacgatccgtagcgggtctgagaggacgatccgccgcattgggactgagacacggcccaaactcctacgggaggcagcagtggggaattttggacaatgggggcaaccctgatccagccatgccgcgtgtctgaagaaggccttcgggttgtaaaggacttttgctagggaagatgacggtacctaaagaataagcaccggctaactacgtgccagcagccgcggtaatacgtagggtgcgagcgttaatcggaattactgggcgtaaagcgagcgcagacggtttgtcaagcaggatgtgaaatccccgagctcaacttgggaactgcgttctgaactggcaggctagagtatgtcagaggggggtagaattccacgtgtagcagtgaaatgcgtagagatgtggaggaataccgatggcgaaggcagccccctggggtaactgacgttcatgctcgaaagcgtgggtagcaaacaggattagataccctggtagtccacgccctaaacgatgtcaattagctgttgggcgcttagtagcgaagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgcacaggtgctgcatggctgtcgtcagctcgtgtcgtgagatgttgggttaagtcccgcaacgagcgcaacccttgtcattagttgccatcatgggcactctaatgagactgccggtgacaaaccggaggaaggtggggatgacgtcaagtcctcatggcccttatgaccagggcttcacacgtcatacaatggttggcagagggtagccaaatcgcgagatggagccaatcccagccaatcgtagtccggatgcactctgcaactcgagtgcagaagtcggaatcgctagtaatcgcaggtcagcatactgcggtgaatacgttcccgggtcttgtacacaccgcccgtcacaccatgggagtgggggataccagaagtaggtggctaggccgcttaccacggtatg

SEQ ID NO: 1333 - DNA, 1553 bp, Neisseria gonorrhoeae
gattgaacataagagtttgatcctggctcagattgaacgctggcggcatgctttacacatgcaagtcggacggcagcacagggaagcttgcttctcgggtggcgagtggcgaacgggtgagtaacatatcggaacgtaccgggtagcgggggataactgatcgaaagatcagctaataccgcatacgtcttgagagggaaagcaggggaccttcgggccttgcgctatccgagcggccgatatctgattagctggttggcggggtaaaggcccaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggccgttgccaatatcggcggccgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtggaattccacgtgtagcagtgaaatgcgtagagatgtggaggaataccgatggcgaaggcagcctcctgggataacactgacgttcatgtccgaaagcgtgggtagcaaacaggattagataccctggtagtccacgccctaaacgatgtcaattagctgttgggcaacttgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggttttgacatgtgcggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattcggttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctagagaa

SEQ ID NO: 1334 - DNA, 1549 bp, Neisseria lactamica
tgaacataagagtttgatcctggctcagattgaacgctggcggcatgctttacacatgcaagtcggacggcagcggggtagtgcttgcactactgccggcgagtggcgaacgggtgagtaacatatcggaacgtaccgggcagtgggggataactgatcgaaagatcagctaataccgcatattttctgaggaagaaagcaggggaccttcgggccttgcgctatccgagcggccgatatctgattagctggttggcggggtaaaggcccaccaaggcgacgatcagtagcgggtctgagaggacgatccgccacactgggactgagacacggcccagactcctacgggaggcagcagtggggaattttggacaatgggcgcaagcctgatccagccatgccgcgtgtctgaagaaggccttcgggttgtaaaggacttttgtcggggaagaaaaggtcggggttaataccctcggctgatgacggtacccgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaattgcgttctgaactgggtggctagagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcgattagctgttgggcagcctgactgcttggtagcgaagctaacgcgtgaaatcgaccgcctggggagtacggtcgcaagattaaaactcaaaggaattgacggggacccgcacaagcggtggatgatgtggattaattcgatgcaacgcgaagaaccttacccggttttgacatgtacggaatcctccggagacgggggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccggggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagcaggtaggctaaccgcaaggaggccgcttgccacggtatgcttcatgactggggtgaagtcgtaacaaggtagccgtaggggaacctgcggctggatcacctcctttctagaga

SEQ ID NO: 1335 - DNA, 1529 bp, Neisseria macacae
agagtttgatcctggctcagattgaacgctggcggcatgctttacacatgcaagtcggacggcagcacagagaagcttgcttcttgggtggcgagtggcgaacgggtgagtaacatatcggaacgtaccgagcagtgggggataactaatcgaaagattagctaataccgcatatattctgaggaagaaagcaggggaccatttggccttgcgctgtttgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaagggcggggttaatacccctgtctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcgattagctgttgggcagcatgactgcttagtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccctccagagacggaggggtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacct

SEQ ID NO: 1336 - DNA, 1549 bp, Neisseria meningitidis
tgaacataagagtttgatcctggctcagattgaacgctggcggcatgctttacacatgcaagtcggacggcagcacagagaagcttgcttctcgggtggcgagtggcgaacgggtgagtaacatatcggaacgtaccgagtagtgggggataactgatcgaaagatcagctaataccgcatacgtcttgagagagaaagcaggggaccttcgggccttgcgctattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggacaacactgacgttcatgcccgaaagcgtgggtagcaaacaggattagataccctggtagtccacgccctaaacgatgtcaattagctgttgggcaacctgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccacaaggagtccgcttaccacggtatgcttcatgactggggtgaagtcgtaacaaggtagccgtaggggaacctgcggctggatcacctcctttctagaga

SEQ ID NO: 1337 - DNA, 1547 bp, Neisseria mucosa
aacataagagtttgatcctggctcagattgaacgctggcggcatgctttacacatgcaagtcggacggcagcacagagaagcttgcttcttgggtggcgagtggcgaacgggtgagtaacatatcggaacgtaccgagcagtgggggataactaatcgaaagattagctaataccgcatatattctgaggaagaaagcaggggaccatttggccttgcgctgtttgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggatagggttaatacccctgtctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcgattagctgttgggcagcttgactgcttagtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccctccagagacggaggggtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctagaga

SEQ ID NO: 1338 - DNA, 1352 bp, Neisseria pharyngis
cacagagaagcttgcttcttgggtggcgagtggcgaacgggtgagtaacatatcggaacgtaccgagcagtgggggataactaatcgaaagattagctaataccgcatatattctgaggaagaaagcaggggaccatttggccttgcgctgtttgagcggccgatatctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggacagggttaatacccctgtctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcgattagctgttgggcagcttgactgcttagtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccctccagagacggaggggtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtggggg

SEQ ID NO: 1339 - DNA, 1545 bp, Neisseria polysaccharea
ttgaacataagagtttgatcctggctcagattgaacgctggcggcatgctttacacatgcaagtcggacggcagcacagagaagcttgcttcttgggtggcgagtggcgaacgggtgagtaacatatcggaacgtaccgagtagtgggggataactgatcgaaagatcagctaataccgcatacgtcttgagagggaaagcaggggaccttcggaccttgcgctattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcaattagctgttgggcaacttgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattcggttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtgggtaggataaccgcaaggggtccgcttaccacggtatgcttcatgactggggtgaagtcgtaacaaggtagccgtaggggaacctgcggctggatcacctcctttct

SEQ ID NO: 1340 - DNA, 1549 bp, Neisseria sicca
tgaacataagagtttgatcctggctcagattgaacgctggcggcatgctttacacatgcaagtcggacggcagcacagagaagcttgcttcttgggtggcgagtggcgaacgggtgagtaacatatcggaacgtaccgagcagtgggggataactaatcgaaagattagctaataccgcatatcttctgaggaagaaagcaggggaccatttggccttgcgctgtttgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaagggcggggttaatacccctgtctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacttgggaactgcgttctgaactgggtgactagagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcgattagctgttgggcagcatgactgcttagtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccctccagagacggaggggtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctagaga

SEQ ID NO: 1341 - DNA, 1254 bp, Neisseria sp.
  KEM232
ctttacacatgcaagtcggacgagtggcgaacgggtgagtaatgtattggaacgtaccgagtaatgggggataaccaatcgaaagattggctaataccgcatacggaaaggcgttattcgagcggccaatatctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagatgacggtacctgaagaataagcaccggctaactacgtgccagcagccgcggtaatacgtagggtgcgagcgttaatcggaattactgggcgtaaagcgggcgcagacggtttgttaagcaggatgtgaaatccccgggctcaacccgggaactgcgttctgaactggcaggctagagtgtgtcagaggggggtagaattccacgtgtagcagtgaaatgcgtagagatgtggaggaataccgatggcgaaggcagccccctgggataactgacgttcatgcccgaaagcgtgggtagcaaacaggattagataccctggtagtccacgccctaaacgatgtcgattagctgttgggcgcttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgcacaggtgctgcatggctgtcgtcagctcgtgtcgtgagatgttgggttaagtcccgcaacgagcgcaacccttgtcattagttgccatcatgggcactctaatgagactgccggtgacaaaccggaggaaggtggggatgacgtcaagtcctcatggcccttatgaccagggcttcacacgtcatacaatggtcggcagagggtagccaagccgcgaggcggagccaatcccagccgatcgtagtccggatgcactctgcaactcgagtgcagaagtcggaatcgctagtaatcgcaggtcagcatactgcggtgaatacgttcccgggtcttgtacacaccgcccgtcacaccatgggagtgggggataccagaagcaggtggctaggccgcttgccacg

SEQ ID NO: 1342 - DNA, 1406 bp, Neisseria sp.
  SMC-A9199
gcaagtcggacggcagcgaggaagtgcttgcacttctgtcggcgagtggcgaacgggtgagtaacatatcggaacgtaccgagtagtgggggataactaatcgaaagattagctaataccgcatacgtcttgagagagaaagcaggggaccttcgggccttgcgctattcgagcggccgatatctgattagctagttggtggggtaaaggcccaccaaggcgacgatcagtagcgggtctgagaggatgatccgccacactgggactgagacacggcccagactcctacgggaggcagcagtggggaattttggacaatgggcgcaagcctgatccagccatgccgcgtgtatgaagaaggccttcgggttgtaaagtacttttgtcagggaagaaaaggccggtgttaataccattggctcatgacggtacctgaagaataagcaccggctaactacgtgccagcagccgcggtaatacgtagggtgcgagcgttaatcggaattactgggcgtaaagcgagcgcagacggtttgttaagcaggatgtgaaatccccgggctcaacctgggaactgcgttctgaactggcaagctagagtgtgtcagaggggggtagaattccacgtgtagcagtgaaatgcgtagagatgtggaggaataccgatggcgaaggcagccccctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccttcgggagtccgct

SEQ ID NO: 1343 - DNA, 1363 bp, Neisseria sp.
  TM10_1
  modified_base (1352)..(1352): a, c, t, g, unknown or other
cacagagaagcttgcttcttgggtggcgagtggcgaacgggtgagtaacatatcggaacgtaccgagcagtgggggataactaatcgaaagattagctaataccgcatatcttctgaggaagaaagcaggggaccatttggccttgcgctgtttgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaagggcggggttaatacccctgtctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcgattagctgttgggcagcatgactgcttagtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtggggngatacagaagt

SEQ ID NO: 1344 - DNA, 1499 bp, Neisseria sp.
  oral clone AP132
agagtttgatatggctcagattgaacgctggcggcatgctttacacatgcaagtcggacggcagcggggagtgcttgcactctgccggcgagtggcgaacgggtgagtaatgcatcggaacgtaccgagtaatgggggataactgtccgaaaggacagctaataccgcatacgccctgagggggaaagcgggggatcttaggacctcgcgttattcgagcggccgatgtctgattagctagttggtggggtaaaggcctaccaaggcgacgatcagtagcgggtctgagaggacgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggcgggtgctaataccatctgctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacgctgacgttcatgcccgaaagcgtgggtagcaaacaagattagataccctggtagtccacgccctaaacgatgtcgattagctgctgggcagcttgactgcttagtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccctccagagacggaggggtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcgtgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaagggtarc

SEQ ID NO: 1345 - DNA, 1363 bp, Neisseria sp.
  oral clone JC012
gagtttgattctggctcagattgaacgcgggcgccatgctttacacatgcaagtcgaacgagtggcgaacgggtgagtaacatattggaacgtaccgagtaaagggggataactatccgaaaggatagctaataccgcatacggaaagacgttattcgagcggccaatatctgattagctagttggtggggtaaaggcctaccaaggcgacgatcagtagcgggtctgagaggacgatccgccacactgggactgagacacggcccagactcctacgggaggcagcagtggggaattttggacaatgggcgcaagcctgatccagccatgccgtgtgtctgaagaaggccttcgggttgtaaaggacttttgttagggaagatgacggtacctaaagaataagcaccggctaactacgtgccagcagccgcggtaatacgtagggtgcgagcgttaatcggaattactgggcgtaaagcgagcgcagacggtttgttaagcaggatgtgaaatccccaggctcaacttgggaactgcgttctgaactggcaagctagagtgtgtcagaggggggtagaattccacgtgtagcagtgaaatgcgtagagatgtggaggaataccgatggcgaaggcagccccctgggataactgacgttcatgctcgaaagcgtgggtagcaaacaggattagataccctggtagtccacgccctaaacgatgtcaattagctgttgggcgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgcacaggtgctgcatggctgtcgtcagctcgtgtcgtgagatgttgggttaagtcccgcaacgagcgcaacccttgtcattagttgccatcatgggcactctaatgagactgccggtgacaaaccggaggaaggtggggatgacgtcaagtcctcatggcccttatgaccagggcttcacacgtcatacaatggtcggcagagggtcgccaagccgcgaggtggagccaatctcacccgatcgtagtccggatgcactctgcaactcgagtgcagaagtcggaatcgctagtaatcgcaggtcagcatactgcggtgaatacgttcccgggtcttgtacacaccgcccgtcacaccatgggagtgggggataccagaagtaggtggctaggccgcttaccacggtatgtttcatgactggggtgaagtcgtaacaaggtagccgtaggggaacctgcggctggaacacctcctt

SEQ ID NO: 1346 - DNA, 1473 bp, Neisseria sp.
  oral strain B33KA
gattgaacgctggcggcatgctttacacatgcaagtcggacggcagcacagagaagcttgcttcttgggtggcgagtggcgaacgggtgagtaatgtattggaacgtaccgagtaatgggggataaccaatcgaaagattggctaataccgcatacgtcctgagggggaaagcgggggatcttcggacctcgcgttattcgagcggccaatatctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggcttttgataataccaggagctgatgacggtacctgaagaataagcaccggctaactacgtgccagcagccgcggtaatacgtagggtgcgagcgttaatcggaattactgggcgtaaagcgggcgcagacggtttgttaagcaggatgtgaaatccccgggctcaacccgggaactgcgttctgaactggcaggctagagtgtgtcagaggggggtagaattccacgtgtagcagtgaaatgcgtagagatgtggaggaataccgatggcgaaggcagccccctgggataacactgacgttcatgcccgaaagcgtgggtagcaaacaggattagataccctggtagtccacgccctaaacgatgtcgattagctgttgggcagcttgactgcttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcctcatggcccttatgaccagggcttcacacgtcatacaatggtcggtacagagggtagccaagccgcgaggcggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagcaggtaggctaaccgcaaggaggccgcttgccacggtatgcttcatgactggggtgaagtcgtaa

SEQ ID NO: 1347 - DNA, 1545 bp, Neisseria sp.
  oral taxon 014
ttgaacataagagtttgatcctggctcagattgaacgctggcggcatgctttacacatgcaagtcggacggcagcggggtagtgcttgcactactgccggcgagtggcgaacgggtgagtaacatatcggaacgtaccgagcagtgggggataactaatcgaaagattagctaataccgcatatattctgaggaagaaagcaggggacctttgggccttgcgctgtttgagcggccgatatctgattagctggttggtggggtaaaggcctaccaaggcgacgatcagtagcgggtctgagaggatgatccgccacactgggactgagacacggcccagactcctacgggaggcagcagtggggaattttggacaatgggggcaaccctgatccagccatgccgcgtgtctgaagaaggccttcgggttgtaaaggacttttgtccgggaagaaaagcgcgatgttaataccattgcgtgctgacggtaccggaagaataagcaccggctaactacgtgccagcagccgcggtaatacgtagggtgcgagcgttaatcggaattactgggcgtaaagcgggcgcagacggttacttaagcaggatgtgaaatccccgggctcaacctgggaattgcgttctgaactgggtggctagagtgtgtcagaggggggtagaattccacgtgtagcagtgaaatgcgtagagatgtggaggaataccgatggcgaaggcagccccctgggatagcactgacgttcatgcccgaaagcgtgggtagcaaacaggattagataccctggtagtccacgccctaaacgatgtcgattagctgttgggcaacttgattgcttggtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccttccggagacggaagggtgccttcgggagccgtaacacaggtgctgcatggctgtcgtcagctcgtgtcgtgagatgttgggttaagtcccgcaacgagcgcaacccttgtcattagttgccatcatttggttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatcccaaaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagcaggtaggctaaccgcaagggggccgcttgccacggtatgcttcatgactggggtgaagtcgtaacaaggtagccgtaggggaacctgcggctggatcacctcctttct

SEQ ID NO: 1348 - DNA, 1549 bp, Neisseria subflava
tgaacataagagtttgatcctggctcagattgaacgctggcggcatgctttacacatgcaagtcggacggcagcacagagaagcttgcttcttgggtggcgagtggcgaacgggtgagtaatatatcggaacgtaccgagtaatgggggataactaatcgaaagattagctaataccgcatattctctgaggaggaaagcaggggaccttcgggccttgcgttattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaataccgacagctgatgacggtacctgaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggaaccgtaacacaggtgctgcatggctgtcgtcagctcgtgtcgtgagatgttgggttaagtcccgcaacgagcgcaacccttgtcattagttgccatcatttagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctagaga

SEQ ID NO: 1349 - DNA, 1495 bp, Neorickettsia risticii
atttgagagtttgatcctggctcagaacgaacgctagcggtaggcttaacacatgcaagtcgaacggaatcagggctgcttgcagccttggtcccgtggcagacgggtgcgtaacgcgtgggaacttgcctggtagtagggaataaccagtggaaacattgggcaacaccctatacgccctgagggggaaaatttattgctatcagataggcccgcgttagattagctagttggtggggtaatggcctaccaaggcgacgatctatagctggtctgagaggatgatcagccacactggaactgagacacggtccagactcctacgggaggcagcagtgaggaatattggacaatgggcgaaagcctgatccagccataccgcatgagtgatgaaggcccttgggttgtaaagctcttttagtggggaagataatgacggtacccacagaagaagtcccggctaactccgtgccagcagccgcggtaatacggagggggctagcgttgttcggaattactgggcgtaaagggtgcgtaggcggtcccgtaagttaggtgtgaaatccttgggcttaacccaagaactgcatttaaaactgtgggactcgaacgtgagagagggcaatggaatttttggtgtaggggtgaaatccgtagatatcaagaggaacgtcaggggcgaaagcgattgcctggatcacagttgacgctgaggcacgaaagcgtggggagcaaacaggattagataccctggtagtccacgctgtaaacgatgagtgttaaaagtgggttattttatctgctttgtagctaacgcgttaaacactccgcctggggactacggtcgcaagactaaaactcaaaggaattgacggggactcgcacaagcggtggagtatgtggtttaattcgatgcaacgcgaaaaaccttaccataccttgacatgtggattgtatccctctgaagggagggagtcagttcggctggatccaacacaggtgttgcatggctgtcgtcagctcgtgtcgtgagatgttgggttaagtcccgcaacgagcgcaaccctcatccttagttgccagcggttcggccgggaactttaaggaaactgccagtgacaagctggaggaaggtggggacgacgtcaagtcatcatggcccttatggtatgggctacacacgtactacaatggcaactacaatgagctagctacaccgtaaggtgacgccaatctcttaaaggttgtctcagtacggattgccttctgcaactcgaaggcatgaagttggaatcgctagtaatcgcagatcagcatgctgcggtgaatacgttctcgggtcttgtacacactgcccgtcaggccatgggagttcatcttactcgaagctagtgagctgaccgcaaggaggcagctatctacggtggggtgggtgactggggttaagtcgtaacaaggtagccgtaggtgaacctgcggctggattacctccttt

SEQ ID NO: 1350 - DNA, 1495 bp, Neorickettsia sennetsu
atttgagagtttgatcctggctcagaacgaacgctagcggtaggcttaacacatgcaagtcgaacggaatcaaagctgcttgcagccttggtcccgtggcagacgggtgcgtaacgcgtgggaacttgcctggtagtagggaataaccagtggaaacattgggcaacaccctatacgccctgagggggaaaatttattgctatcagataggcccgcgttagattagctagttggtggggtaatggcctaccaaggcgacgatctatagctggtctgagaggatgatcagccacactggaactgagacacggtccagactcctacgggaggcagcagtgaggaatattggacaatgggcgaaagcctgatccagccataccgcatgagtgatgaaggcccttgggttgtaaagctcttttagtggggaagatagtgacggtacccacagaagaagtcccggctaactccgtgccagcagccgcggtaatacggagggggctagcgttgttcggaattactgggcgtaaagggtgcgtaggcggtcccgtaagttaggtgtgaaatccttgggcttaacccaggaactgcatttaaaactgcgggactcgaacgtgagagagggcaatggaatttttggtgtaggggtgaaatccgtagatatcaagaggaacgtcaggggcgaaagcgattgcctggatcacagttgacgctgaggcacgaaagcgtggggagcaaacaggattagataccctggtagtccacgctgtaaacgatgagtgttaaaagtgggttattttatctgctttgtagctaacgcgttaaacactccgcctggggactacggtcgcaagactaaaactcaaaggaattgacggggactcgcacaagcggtggagtatgtggtttaattcgatgcaacgcgaaaaaccttaccataccttgacatgtggatcgtatccctctgaagggagggagtcagttcggctggatccaacacaggtgttgcatggctgtcgtcagctcgtgtcgtgagatgttgggttaagtcccgcaacgagcgcaaccctcatccttagttgccagcggttcggccgggaactttaaggaaactgccagtgacaagctggaggaaggtggggacgacgtcaagtcatcatggcccttatggtatgggctacacacgtactacaatggcaactacaatgggctagctacaccgtaaggtgatgcaaatctcctaaaagttgtctcagtacggattgccttctgcaactcgaaggcatgaagttggaatcgctagtaatcgcagatcagcatgctgcggtgaatacgttctcgggtcttgtacacactgcccgtcaggccatgggagttcatcttactcgaagctagtgagctgaccgcaaggaggcagctatctacggtggggtgggtgactggggttaagtcgtaacaaggtagccgtaggtgaacctgcggctggattacctccttt

SEQ ID NO: 1351 - DNA, 1530 bp, Nocardia brasiliensis
tcttcaacggagagtttgatcctggctcaggacgaacgctggcggcgtgcttaacacatgcaagtcgagcggtaaggcccttcggggtacacgagcggcgaacgggtgagtaacacgtgggtgatctgcctcgcacttcgggataagcctgggaaactgggtctaataccggatatgacctttcagtgcatgctgttgggtggaaagatttatcggtgcgagatgggcccgcggcctatcagcttgttggcggggtaacggcccaccaaggcgacgacgggtagccgacctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcgacagggacgaagcgcaagtgacggtacctgtagaagaagcaccggccaactacgtgccagcagccgcggtaatacgtagggtgcgagcgttgtccggaattactgggcgtaaagagcttgtaggcggtttgtcgcgtcgtccgtgaaaacttggggctcaaccccaagcttgcgggcgatacgggcagacttgagtacttcaggggagactggaattcctggtgtagcggtgaaatgcgcagatatcaggaggaacaccggtggcgaaggcgggtctctgggaagtaactgacgctgagaagcgaaagcgtgggtagcgaacaggattagataccctggtagtccacgccgtaaacggtgggtactaggtgtgggtttccttccacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccggaaacctgcagagatgtaggcccccttgtggtcggtgtacaggtggtgcatggctgtcgtcagctcgtgtcgtgagatgttgggttaagtcccgcaacgagcgcaacccttgtcctgtgttgccagcggattatgccggggactcgcaggagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggattggcgattgggacgaagtcgtaacaaggtagccgtaccggaaggtgcggctggatcacctcctttctaaggag

SEQ ID NO: 1352 - DNA, 1434 bp, Nocardia cyriacigeorgica
ttaacacatgcaagtcgagcggtaaggcccttcggggtacacgagcggcgaacgggtgagtaacacgtgggtgatctgcctcgcactctgggataagcctgggaaactgggtctaataccggatatgaccttacatcgcatggtgtttggtggaaagatttatcggtgcgagatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcgacagggacgaagcgcaagtgacggtacctgtagaagaagcaccggccaactacgtgccagcagccgcggtaatacgtagggtgcgagcgttgtccggaattactgggcgtaaagagcttgtaggcggcttgtcgcgtcgatcgtgaaaacttggggctcaaccccaagcttgcggtcgatacgggcaggcttgagtacttcaggggagactggaattcctggtgtagcggtgaaatgcgcagatatcaggaggaacaccggtggcgaaggcgggtctctgggaagtaactgacgctgagaagcgaaagcgtgggtagcgaacaggattagataccctggtagtccacgccgtaaacggtgggtactaggtgtgggtttccttccacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccggaaacctgcagagatgtaggcccccttgtggtcggtgtacaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaag

SEQ ID NO: 1353 - DNA, 1522 bp, Nocardia farcinica
cttcaacggagagtttgatcctggctcaggacgaacgctggcggcgtgcttaacacatgcaagtcgagcggtaaggcccttcggggtacacgagcggcgaacgggtgagtaacacgtgggtgatctgccctgtacttcgggataagcctgggaaactgggtctaataccggatatgaccttacatcgcatggtgtttggtggaaagatttatcggtacaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcgacagggacgaagcgcaagtgacggtacctgtagaagaagcaccggccaactacgtgccagcagccgcggtaatacgtagggtgcgagcgttgtccggaattactgggcgtaaagagcttgtaggcggtttgtcgcgtcgtccgtgaaaacttggggctcaactccaagcttgcgggcgatacgggcagacttgagtactgcaggggagactggaattcctggtgtagcggtgaaatgcgcagatatcaggaggaacaccggtggcgaaggcgggtctctgggcagtaactgacgctgagaagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaacctgcagagatgtaggcccccttgtggtcggtgtacaggtggtgcatggctgtcgtcagctcgtgtcgtgagatgttgggttaagtcccgcaacgagcgcaaccttgtcctgtgttgccagcgcgttatggcggggactcgcaggagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttct

SEQ ID NO: 1354 - DNA, 1328 bp, Nocardia puris
aacacatgcaagtcgagcgagcggcgaacgggtgagtaacacgtgggtgatctgccctgcactctgggataagcctgggaaactgggtctaataccggatatggaaagtcggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcgacagggacgatgacggtacctgtagaagaagcaccggccaactacgtgccagcagccgcggtaatacgtagggtgcgagcgttgtccggaattactgggcgtaaagagcttgtaggcggcttgtcgcgtcgatcgtgaaaacttggggctcaaccccaagcttgcggtcgatacgggcaggcttgagtactgcaggggagactggaattcctggtgtagcggtgaaatgcgcagatatcaggaggaacaccggtggcgaaggcgggtctctgggcagactgacgctgagaagcgaaagcgtgggtagcgaacaggattagataccctggtagtccacgccgtaaacggtgggcgctaggtgtgggttgatccgtgccgtagctaacgcattaagcgccccgcctggggagtacggccgcaggctaaaactcaaaggaattgacgggggcccgcacaagcggcggagcatgtggattaattcgatgcaacgcgaagaaccttacctgggtttgacatatacaggtggtgcatggctgtcgtcagctcgtgtcgtgagatgttgggttaagtcccgcaacgagcgcaacccttgtcctgtgttgccagcaattggggactcgcaggagactgccggggtcaactcggaggaaggtggggacgacgtcaagtcatcatgccccttatgtccagggcttcacacatgctacaatggccggcagagggctgcgataccgtgaggtggagcgaatcccttccggtctcagttcggacggggtctgcaactcgaccccggaagttggagtcgctagtaatcgcagatcagcaacgctgcggtgaatacgttcccgggccttgtacacaccgcccgtcacgtcatgaaagtcggtaacacccgaagccggtgcccagggagccgtcgaaggtgggatcggcgattgggacgaagtcgtaacaaggtagccgtaccggaaggtgcggctggatcacctcctttct

SEQ ID NO: 1355 - DNA, 1375 bp, Nocardia sp.
  01-Je-025
cggtaaggcccttcggggtacacgagcggcgaacgggtgagtaacacgtgggtgatctgcctcgcacttcgggataagcctgggaaactgggtctaataccggatatgaccgactagtgcatgctggttggtggaaagatttatcggtgcgagatgggcccgcggcctatcagcttgttggtgaggtaacggctcaccaaggcgacgacgggtagccgacctgagagggtgaccggccacactgggactgagacacggcccagactcctacgggaggcagcagtggggaatattgcacaatgggcgaaagcctgatgcagcgacgccgcgtggaggatgacggccttcgggttgtaaactcctttcgacagggacgaagcgaaagtgacggtacctgtagaagaagcaccgggccaactacgtgccagcagccgcggtaatacgtagggtgcgagcgttgtccggaattactgggcgtaaagagcttgtaggcggtctgtcgcgtcttctgtgaaaacttggggctcaaccttaagcttgcaggcgatacgggcagactagagtacttcaggggagactggaattcctggtgtagcggtgaaatgcgcagatatcaggaggaacaccggtggcgaaggcgggtctctgggaagtaactgacgctgagaagcgaaagcatgggtagcaaacaggattagataccctggtagtccatgccgtaaacggtgggtactaggtgtgggtttccttccacgggatccgtgccgyagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatacaccggaaacctgcagagatgtaggcccccttgtggtcggtgtacaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggacgacgtcaagtcatcatgccccttatgtccagggcttcacacatgctacaatggccagtacagagggctgcgagaccgcgaggtggagcgaatcccttaaagctggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagcc

SEQ ID NO: 1356 - DNA, 1528 bp, Nocardiopsis dassonvillei
tttatggagagtttgatcctggctcaggacgaacgctggcggcgtgcttaacacatgcaagtcgagcggtaaggcccttcggggtacacgagcggcgaacgggtgagtaacacgtgagcaacctgcccctgactctgggataagcggtggaaacgccgtctaataccggatacgacccgccacctcatggtggagggtggaaagtttttcggtcagggatgggctcgcggcctatcagcttgttggtggggtaacggcctaccaaggcgattacgggtagccggcctgagagggcgaccggccacactgggactgagacacggcccagactcctgcgggaggcagcagtggggaatattgcgcaatgggcgaaagcctgacgcagcgacgccgcgtgggggatgacggccttcgggttgtaaacctcttttaccaccaacgcaggcttccagttctctggaggttgacggtaggtggggaataaggaccggctaactacgtgccagcagccgcggtaatacgtagggtccgagcgttgtccggaattattgggcgtaaagagctcgtaggcggcgtgtcgcgtctgctgtgaaagaccggggcttaactccggttctgcagtggatacgggcatgctagaggtaggtaggggagactggaattcctggtgtagcggtgaaatgcgcagatatcaggaggaacaccggtggcgaaggcgggtctctgggccttacctgacgctgaggagcgaaagcatggggagcgaacaggattagataccctggtagtccatgccgtaaacgttgggcgctaggtgtggggactttccacggtttccgcgccgtagctaacgcattaagcgccccgcctggggagtacggccgcaggctaaaactcaaggaattgacgggggcccgcacaagcggcggagcattgttgcttaattcgacgcagcgcgaagaaccttaccaaggtttgacatcacccgtggactcgcagagatgtgaggtcatttagttggcgggtgacaggtggggcatggctgtcgtcagctcgtgtcgtgagatgttgggttagtcccgcaacgagcgcaatccttgttcatgttgtcagcatgtatggtggggactcttgggagactggccggggtcaactcggagaagggtggggatgacgtcagtctcatgccccttatgtctgggctgcaaacatgctacaatggccggtacaatgggcgtgcgatacgtaaggtggagcgaatccctaaaagccggtctcagttcggattggggtctgcaactcgaccccatgaaggtggagtcgctagtaatcgcggatcagcaacgccgcggtgaatacgttcccgggccttgtacacaccgcccgtcacgtcatgaaagtcggcaacacccgaaacttgcggcctaaccccttgtgggagggagtgagtgaaggtggggctggcgattgggacgaagtcgtaacaaggtagccgtaccggaaggtgcggctggatcacctcctttct

SEQ ID NO: 1357 - DNA, 1486 bp, Novosphingobium aromaticivorans
aacttgagagtttgatcctggctcagaacgaacgctggcggcatgcctaacacatgcaagtcgaacgaacccttcggggttagtggcgcacgggtgcgtaacgcgtgggaatctgccctttgcttcggaataacagttagaaatgactgctaataccggatgatgtcttcggaccaaagatttatcggcaagggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgcaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagcgcacgtaggcggctactcaagtcagaggtgaaagcccggggctcaaccccggaactgcctttgaaactaggtagctggaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccggtcacttggtgattgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgcgctacttccagagatggaaggttcccttcggggacgcggtgacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacacgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttct

SEQ ID NO: 1358 - DNA, 1529 bp, Oceanobacillus caeni
agagtttgatcctggctcaggacgaacgctggcggcgtgcctaatacatgcaagtcgagcgctggaagctaatttcatcccttcgggatgaaattagtggaaagagcggcggacgggtgagtaacacgtgggcaacctacctataagactgggataactcgcggaaacgtgagctaataccggataatactttttattgcataataaggagtttgaaaggcggcgtaagctgtcacttatagatgggcccgcggcgcattagctagttggtgaggtaaaggctcaccaaggcaacgatgcgtagccgacctgagagggtgatcggccacactgggactgagacacggcccagactcctacgggaggcagcagtagggaatcttccgcaatggacgaaagtctgacggaacaacgccgcgtgagtgaagaaggttttcggatcgtaaaactctgttgttagggaagaacaagtcaggtagtaactgacctgaccttgacggtacctaaccagaaagccacggctaactacgtgccagcagccgcggtaatacgtaggtggcaagcgttgtccggatttattgggcgtaaagcgctcgcaggcggtcttttaagtctgatgtgaaagcccacggcttaaccgtggagggtcattggaaactggaggacttgagtgcagaagaggagagtggaattccatgtgtagcggtgaaatgcgtagagatatggaggaacaccagtggcgaaggcgactctctggtctgtaactgacgctgaggagcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctttcgacctccctagagatagggatttcccttcggggacgaaagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggtacaaagggcagcgaaaccgcaaggtcaagcaaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagttggtaacacccgaagtcggtgaggtaaccttttggagccagccgccgaaggtgggaccaatgattggggtgaagtcgtaacaaggtaaccca

SEQ ID NO: 1359 - DNA, 1347 bp, Oceanobacillus sp.
  Ndiop
tcctggcaagaagatgaaaggcggcttttagctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtgcgagagtaactgctcgcaccttgacggtacctgaccagaaagccacggctaactacgtgccagcagccgcggtaatacgtaggtggcaagcgttgtccggaattattgggcgtaaagcgctcgcaggcggtcttttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgaccaccctagagatagggatttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggaagcgaaaaccgcgaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggactaatgattggggtgaagtcgtaacaaggtagccgtatcggaaggtgcggctg

SEQ ID NO: 1360 - DNA, 1487 bp, Ochrobactrum anthropi
ttcaacttgagagtttgatcctggctcagaacgaacgctggcggcaggcttaacacatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttct

SEQ ID NO: 1361 - DNA, 1493 bp, Ochrobactrum intermedium
aacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgagcccgaaaggggaaagatttatcggcaaatgatcggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcgggctaataagtcaggggtgaaatcccggggctcaaccccggaactgcctttgatactgttagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggttagtggagacactatccttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaaggaag

SEQ ID NO: 1362 - DNA, 1396 bp, Ochrobactrum pseudintermedium
gagagtttgatcctggctcagaacgaacgctggcggcaggcttaacacatgcaagtcgagcgcgtagcaatacgagcggcagacgggtgagtaacgcgtgggaatctacccatcactagggaataactcagggaaacttgtgctaataccctatacgaccgagaggtgaaagatttatcggtgatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcgggctaataagtcaggggtgaaatcccggggctcaaccccggaactgcctttgatactgttagtcttgagtatggaagaggtgagtggaattccgagtgtagaggtgaaatttgtagatattcggaggaacaccagtggcgaaggcggctcactggtccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaatttgaagcaacgcgcagaaccttaccagcccttgacatcccgatcgcggttagtggagacactttccttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggc

SEQ ID NO: 1363 - DNA, 1317 bp, Odoribacter laneus
gatgaacgctagcgacaggcttaacacatgcaagtcgagggaccggcgcacgggtgagtaacgcgtatgcaacctgcctttgacagagggatagcccatggaaacgtggattaatacctcatagttaaaagtggtcaaagatgggcatgcgtcctattaggcagttggcggggtaacggcccaccaaaccgatgataggtaggggttctgagaggaaggtcccccacactggtactgagacacggaccagactcctacgggaggcagcagtgaggaatattggtcaatggtcgagagactgaaccagccaagtcgcgtgagggatgactgcctatgggttgtaaacctcttttctactgggagatgacagtacagtaggaataagcatcggctaactccgtgccagcagccgcggtaatacggaggatgcgagcgttatccggatttattgggtttaaagggtgcgtaggcggctttataagttagtggtaaaatttcggagcttcactccggtccgccattaaaactgtagagctagagaatggacgaggtaggcggaataagttaagtagcggtgaaatgcatagatataacttagaactccgatagcgaaggcagcttaccagaccaactgacgctgatgcacgagagcgtgggtagcgaacaggattagataccctggtagtccacgccgtaaacgatgctcaccggcccttagcgagttaggggttaattgaaagaattaagtgagccacctggggagtacgtcggcaacgatgaaactcaaaggaattgacgggggcccgcacaagcggaggaacatgtggtttaattcgatgatacgcgaggaaccttacctgggtttaaatgtacaaggtgctgcatggttgtcgtcagctcgtgccgtgaggtgtcgggttaagtcccataacgagcgcaacccttaccgttagttgctaacatatgagcactctagcgggactgccaccgtaaggtggaggaagggggggatgacgtcaaatcagcacggcccttacatccagggcgacacacgtgttacaatggccatcagcgggtagctaccgggtgaccggatgcaaatctcgatggtctaagttcggatggagtctgcaacccgactccagaagttggattcgctagtaatcgcgcatcagccatggcgcggtgaatacgttcccgggccttgtacacaccgcccgtcaagccatggaagctgggagtacctgaagtccgtatcggcctagggtaataccggtaactggggctaagtcgwaacaaggtagccgtaccggaagg

SEQ ID NO: 1364 - DNA, 1368 bp, Odoribacter splanchnicus
tcgaggggcagcatgaggtagcaataccttgatggcgaccggcgcacgggtgagtaacgcgtatgcaacctgcctgataccggggtatagcccatggaaacgtggattaacaccccatagtacttttatcctgcctgggatgggagttaaatgtttaaggtatcggatgggcatgcgtcctattagttagttggcggggtaacagcccaccaagacgatgataggtaggggttctgagaggaaggtcccccacattggaactgagacacggtccaaactcctacgggaggcagcagtgaggaatattggtcaatggacgtaagtctgaaccagccaagtcgcgtgagggaagactgccctatgggttgtaaacctcttttataagggaagaataagttctactgtaatgatgcctgtactgataagcatcggctatctgccagcagccgcggtaatacggaggatgcgagcgttatccggatttattgggtttaaagggtgcgtaggcggtttattaagttagtggttaaatatttgagctaaactcaattgtgccattaatactggtaaactggagtacagacgaggtaggcggaataagttaagtagcggtgaaatgcatagatataacttaaactccgatagcgaaggcagcttaccagactgtaactgacgtgatgcacgagagcgtgggtagcgaacaggattagataccctggtagtccacgccgtaaacgatgctcactggttctgtgcgatatattgtacgggattaagcgaaagtattaagtgagccacctggggagtacgtcggcaacgatgaaactcaaaggaattgacgggggcccgcacaagcggaggaacatgtggtttaattcgatgatacgcgaggaaccttacctgggtttaaatgggaaatgccgtatttggaaacagatattctcttcggagcgtttttcaaggtgctgcatggttgtcgtcagctcgtgccgtgaggtgtcgggttaagtcccataacgagcgcaacccttaccgttagttgctagcatgtaatgatgagcactctaacgggactgccaccgtaaggtgagaggaaggcggggatgacgtcaaatcagcacggcccttacacccagggctacacacgtgttacaatggccggtacagagggccgctaccaggtgactggatgccaatctcaaaagccggtcgtagttcggattggagtctgtaacccgactccatgaagttggattcgctagtaatcgcgcatcagccatggcgcggtgaatacgttcccgggccttgtacacaccgcccgtcaagccatggaagccgggggtgcctgaagtccgtaaccgcgaggat

SEQ ID NO: 1365 - DNA, 1398 bp, Okadaella gastrococcus
tgaagcttggtgcttgcaccgagcggatgagttgcgaacgggtgagtaacgcgtaggtaacctgcctcttagcgggggataactattggaaacgatagctaataccgcataaaagacgatatcgcatgatattgatttgaaaggtgcaattgcatcactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggaacatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccag

SEQ ID NO: 1366 - DNA, 1489 bp, Oligella ureolytica
attgaacgctagcgggatgctttacacatgcaagtcgaacggcagcacagaggaacttgttccttgggtggcgagtggcggacgggtgagtaatgtatcggaacgtgcccagtagtgggggataactacgcgaaagcgtggctaataccgcatattctctacggaggaaagggggggatcatttgacctctcgctattggagcggccgatattagattagctagttggtggggtaacggcctaccaaggcagtgatctatagctggtttgagaggacgaccagccacactgggactgagacacggcccagactcctacgggaggcagcagtggggaattttcgacaatggggggaaccctgatcgagccatcccgcgtgtgggacgaaggccttcgggttgtaaaccacttttctcaacgaagaaaagtcttaggctaataccttaagatgctgacggtagttgaggaataagcaccggctaactatgtgccagcagccgcggtaatacatagggtgcaagcgttaatcggaattactgggcgtaaagggtgcgcaggcggcttggaaagaacggtgtgaaatcccggggctcaacctcggaactgcactattaactatcaagctagagtatgtcagaggggggtggaattccgcgtgtagcagtgaaatgcgtagatatgcggaggaacaccaatggcgaaggcagccccctgggataatactgacgctcaggcacgaaagcgtgggtagcaaacaggattagataccctggtagtccacgccctaaacgatgtcaactagctgttgggccggttacggcttagtagcgcagctaacgcgtgaagttgaccgcctggggactacggtcgcaagactaaaactcaaaggaattgacggggacccgcacaagcggtggatgatgtggattaattcgatgcaacgcgaaaaaccttacctacccttgacatgcctggaagctttaagagattaaagtgtgctcgcaagagaaccggtgcacaggtgctgcatggctgtcgtcagctcgtgtcgtgagatgttgggttaagtcccgcaacgagcgcaacccttgtcattagttgctacgtaagagcactctagtgagactgccggtgacaaaccggaggaaggtggggatgacgtcaagtcctcatggcccttatgggtagggcttcacacgtcatacaatggtcgggacagagggttgccaagccgcgaggtggagctaatctcttaaacccgatcgtagtccggattgcaggctgcaactcgcctgcatgaagtcggaatcgctagtaatcgcagatcagaatgctgcggtgaatacgttcccgggtcttgtacacaccgcccgtcacaccatgggagtgggttttaccagaagtagttagtctaaccgcaagggggacgattaccacggtaggattcatgactggggtgaagtcgtaacaaggtagccgtaccggaagg

SEQ ID NO: 1367 - DNA, 1486 bp, Oligella urethralis
ttgatcctggctcagattgaacgctagcgggatgctttacacatgcaagtcgaacggcagcatgagagagcttgctctcttgatggcgagtggcggacgggtgagtaatgtatcggaacgtgcccggtagtgggggataactacgcgaaagcgtagctaataccgcatattctctacggaggaaagagggggatcgtaagacctcttgctaccggagcggccgatatcagattagctagttggtggggtaacggcctaccaaggcggtgatctgtagctggtttgagaggacgaccagccacactgggactgagacacggcccagactcctacgggaggcagcagtggggaattttcgacaatggggggaaccctgatcgagccatctcgcgtgtgggacgaaggccttcgggttgtaaaccacttttctcaacgaagaaaagtcttaggctaataccttaagatgctgacggtagttgaggaataagcaccggctaactacgtgccagcagccgcggtaatacgtagggtgcgagcgttaatcggaattactgggcgtaaagggtgcgcaggcggcttggaaagaacggtgtgaaatcccggggctcaacctcggaactgcactattaactgccaagctagagtatgtcagaggggggtggaattccgcgtgtagcagtgaaatgcgtagatatgcggaggaacaccgatggcgaaggcagccccctgggatggtactgacgctcaggcacgaaagcgtgggtagcgaacaggattagataccctggtagtccacgccctaaacgatgtcaactagctgttgggccggttacggcttagtagcgcagctaacgcgtgaagttgaccgcctggggactacggtcgcaagactaaaactcaaaggaattgacggggacccgcacaagcggtggatgatgtggattaattcgatgcaacgcgaaaaaccttacctacccttgacatgcccggaagcttcaagagattggagtgtgctcgcaagagaaccggagcacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcaggacagcgggttgccaagccgcgaggtggagctaatctcttaaacctgatcgtagtccggattgcaggctgcaactcgcctgcatgaagtcggaatcgctagtaatcgcagatcagaatgctgcggtgaatacgttcccgggtcttgtacacaccgcccgtcacaccatgggagtgggttttaccagaagtagttagcctaaccgcaaggagggcgattaccacggtaggattcatgactggggtgaagtcgtaacaa

SEQ ID NO: 1368 - DNA, 1327 bp, Olsenella sp.
  C1
gatgaacgctggcggcgcgcctaacacatgcaagtcgaacgagtggcgaacggctgagtaacacgtgggcaatctgccctttgcatcgggacagcctcgggaaaccgtggttaataccggatactgaaaggcggcaagggatgggcccgcgccctgttagcttgttggtggggtaaaagcctaccaaggcaatgatgggtagccgggttgagagaccgaccggccagattgggactgagacacggcccagactcctacgggaggcagcagtggggaatcttgcacaatgggcgaaagcctgatgcagcgacgccgcgtgcgggatgaaggccttcgggttgtaaaccgctttcagcagggacgatgacggtacctgcagaagaagccccggctaactatgtgccagcagccgcggtaatacgtagggagcaagcgttatccggattcattgggcgtaaagcgcgcgtaggctgcccagtaggtcgagagttaaatccgggggctcaacccccgtccgctcccgataccgctgggttcgagtctggtaggggaaggtggaattcccagtgtagcggtggaatgcgcagatattgggaagaacaccggtggcgaaggcggccttctgggccaactgacgctgaggcgcgaaagctaggggagcgaacaggattagataccctggtagtcctagccgtaaacgatgggcactaggtgtggggatttccgtgccgacgctaacgcattaagtgccccgcctggggagtacggccgcaaggctaaaactcaaaggaattgacgggggcccgcacaagcagcggagcatgtggcttaattcgaagcaacgcgaagaaccttaccagggcttgacactacaggtggtgcatggctgtcgtcagctcgtgtcgtgagatgttgggttaagtcccgcaacgagcgcaaccctcgtcgcatgttgccagcggccgggcacccatgcgagaccgccggcgttaagccggaggaaggtggggacgacgtcaagtcatcatgccctctatgtcctgggctgcacacgtgctacaatggccggcagcggggtgccactgcgcgagcacaagcgaatccctccggtcccagttcggatggaggctgcaacccgcctccagaagtcggagttgctagtaatcgcggatcagcacgccgcggtgaatgcgttcccgggccttgtacacaccgcccgtcacaccacccgagtcgtctgcacccgaagtcgtcgcctagggaggcgccgaaggtgtggaaggtaaggggggtgaagtcgtaacaaggtaaccgtaagagaacctgc

SEQ ID NO: 1369 - DNA, 1428 bp, Olsenella profusa
gatgaacgctggcggcgcgcctaacacatgcaagtcgaacggttaaagcatcttcggatgtgcataaagtggcgaacggctgagtaacacgtgggcaacctgcccctcgcatcgggacagcctcgggaaaccgtggttaataccggatactccgccacccccgcatgggggaggcgggaaagcccagacggcgagggatgggcccgcggcctgttagcttgttggtggggcagtggcccaccaaggcgatgatgggtagccgggttgagagaccgaccggccagattgggactgagacacggcccagactcctacgggaggcagcagtggggaatcttgcacaatgggcgaaagcctgatgcagcgacgccgcgtgcgggacgaaggccttcgggtcgtaaaccgctttcagcagggacgaggccgcaaggtgacggtacctgcagaagaagccccggctaactacgtgccagcagccgcggtaatacgtagggggcgagcgttatccggattcattgggcgtaaagcgcgcgtaggcggcctgctaggtcgggagtcaaatccgggggctcaacccccgtccgctcccgataccggctggcttgagtctggtaggggaaggtggaattcccagtgtagcggtggaatgcgcagatattgggaagaacaccggtggcgaaggcggccttctgggccacgactgacgctgaggcgcgaaagctaggggagcgaacaggattagataccctggtagtcctagccgtaaacgatggacactaggtgtgggcggattgtccgtccgtgccgcagccaacgcattaagtgtcccgcctggggagtacggccgcaaggctaaaactcaaaggaattgacgggggcccgcacaagcagcggagcatgtggcttaattcgaagcaacgcgaagaaccttaccagggcttgacatctaggtgaagcggcggagacgccgtggccgagaggagcctagacaggtggtgcatggctgtcgtcagctcgtgtcgtgagatgttgggttaagtcccgcaacgagcgcaaccctcgtcgcatgttgccagcggttcggccgggcacccatgcgagaccgccggcgtcaagccggaggaaggtggggacgacgtcaagtcatcatgccccttatgtcctgggctgcacacgtgctacaatggccggcacaatgggctgccaccgcgcgagcgggagcgaatccccaaagccggccccagttcggactggaggctgcaacccgcctccacgaagtcggagttgctagtaatcgcggatcagcacgccgcggtgaatgcgttcccgggccttgtacacaccgcccgtcacaccacccgagtcgtctgcacccgaagtcgtcggcccaacccgcaagggagggaggcgccgaaggtgtggaaggta

SEQ ID NO: 1370 - DNA, 1489 bp, Olsenella sp.
  F0004
gagtttgatcctggctcaggatgaacgctggcggcgcgcctaacacatgcaagtcgaacggttaaagccccttcgggggtgcatagagtggcgaacggctgagtaacacgtgggcaacctgccccccgcaccgggacagcctcgggaaaccgtggttaataccggatactccgccacccccgcatgggggcggcgggaaagcccaggcggagggggatgggcccgcggcctgttagctcgttggcggggtaacggcccaccaaggcgatgatgggtagccgggttgagagaccgaccggccagattgggactgagacacggcccagactcctacgggaggcagcagtggggaatcttgcacaatgggcgaaagcctgatgcagcgacgccgcgtgcgggacgaaggccttcgggtcgtaaaccgctttcagcagggacgaggccgaaaggtgacggtacctgcagaagaagccccggctaactacgtgccagcagccgcggtaatacgtagggggcgagcgttatccggattcattgggcgtaaagcgcgcgcaggcggcctgctcggtcgggagtcaaatccgggggctcaacccccgcccgctcccgataccggcgggcttgagtctggtaggggaaggcggaattcccagtgtagcggtggaatgcgcagatattgggaagaacaccggtggcgaaggcggccttctgggccacgactgacgctgaggcgcgaaagctaggggagcgaacaggattagataccctggtagtcctagccgtaaacgatggacactaggtgtggggggaggatccctccgtgccgcagccaacgcattaagtgtcccgcctggggagtacggccgcaaggctaaaactcaaaggaattgacgggggcccgcacaagcagcggagcatgtggcttaattcgaagcaacgcgaagaaccttaccagggcttgacatgcgggtgaagcggcggagacgccgtggccgagaggagcccgcacaggtggtgcatggctgtcgtcagctcgtgtcgtgagatgttgggttaagtcccgcaacgagcgcaacccccgtcgcatgttgccagcggttaggccgggcacccatgcgagaccgccggcgtcaagccggaggaaggtggggacgacgtcaagtcatcatgccccttatgtcctgggctgcacacgtgctacaatggccggcacagcgggccgccaccgcgcgagcgggagcgaatccccaaagccggccccagttcggattggaggctgcaacccgcctccatgaagtcggagttgctagtaatcgcggatcagcacgccgcggtgaatgcgttcccgggccttgtacacaccgcccgtcacaccacccgagtcgtctgcacccgaagtcgccggcccaacccgcgagggggggaggcgccgaaggtgtggagggtaaggggggtgaagtcgtaacaaggtagccgtaccggaaggtgc

SEQ ID NO: 1371 - DNA, 1503 bp, Olsenella sp.
  oral taxon 809
agagttcgatcctggctcaggatgaacgctggcggcgcgcctaacacatgcaagtcgaacggttaagacgccttcgggcgtgtataaagtggcgaacggctgagtaacacgtgggcaacctgcccctcgcaccgggacagcctcgggaaaccgtggttaataccggatactccgcgcaccccgcatggggcgcgcgggaaagcccagacggcgagggatgggcccgcggcctgttagctagttggcggggcaacggcccaccaaggcgatgatgggtagccgggttgagagaccgaccggccagattgggactgagacacggcccagactcctacgggaggcagcagtggggaatcttgcacaatgggcgaaagcctgatgcagcgacgccgcgtgcgggacgaaggccttcgggtcgtaaaccgctttcagcagggacgaggccgcaaggtgacggtacctgcagaagaagccccggctaactacgtgccagcagccgcggtaatacgtagggggcgagcgttatccggattcattgggcgtaaagcgcgcgtaggcggcctgttaggtcgggagttaaatccgggggctcaacccccgtccgctcccgataccggcgggcttgagtctggtaggggaaggcggaattcccagtgtagcggtggaatgcgcagatattgggaagaacaccggtggcgaaggcggccttctgggccacgactgacgctgaggcgcgaaagctaggggagcgaacaggattagataccctggtagtcctagccgtaaacgatggacactaggtgtggggggacgatccctccgtgccgcagccaacgcattaagtgtcccgcctggggagtacggccgcaaggctaaaactcaaaggaattgacgggggcccgcacaagcagcggagcatgtggcttaattcgaagcaacgcgaagaaccttaccagggcttgacatctaggtgaagcggcggagacgccgtggccgagaggagcctagacaggtggtgcatggctgtcgtcagctcgtgtcgtgagatgttgggttaagtcccgcaacgagcgcaaccctcgtcgcatgttgccagcggtccggccgggcacccatgcgagaccgccggcgtcaagccggaggaaggtggggacgacgtcaagtcatcatgccccttatgtcctgggctgcacacgtgctacaatggccggcacaatgggctgccaccgcgcgagcgggagcgaatccccaaagccggccccagttcggactggaggctgcaacccgcctccacgaagtcggagttgctagtaatcgcggatcagcacgccgcggtgaatgcgttcccgggccttgtacacaccgcccgtcacaccacccgagtcgtctgcacccgaagtcgtcggcccaacccgcgagggggggaggcgccgaaggtgtggagggtaaggggggtgaagtcgtaacaaggtagccgtaccggaaggtgcggctggatcacct

SEQ ID NO: 1372 - DNA, 1503 bp, Olsenella uli
agagttcgatcctggctcaggatgaacgctggcggcgcgcctaacacatgcaagtcgaacggttaaagccccttcgggggtgcataaagtggcgaacggctgagtaacacgtgggcaacctgcccctcgcaccgggacagcctcgggaaaccgtggttaataccggatactcccgcacccccgcatgggggcgcggggaaagcccagacggcgagggatgggcccgcggcctgttagctcgttggcggggtaacggcccaccaaggcgatgatgggtagccgggttgagagaccgaccggccagattgggactgagacacggcccagactcctacgggaggcagcagtggggaatcttgcgcaatgggcggaagcctgacgcagcgacgccgcgtgcgggaaggaggccttcgggtcgtaaaccgctttcagcagggacgaggccgcgaggtgacggtacctgcagaagaagccccggctaactacgtgccagcagccgcggtaatacgtagggggcaagcgttatccggattcattgggcgtaaagcgcgcgtaggcggcctgttaggtcgggagtcaaatccgggggctcaacccccgcccgctcccgataccggcgggcttgagtctggcaggggaaggcggaattccaagtgtagcggtggaatgcgcagatatttggaagaacaccggtggcgaaggcggccttctgggccacgactgacgctgaggcgcgaaagctaggggagcgaacaggattagataccctggtagtcctagccgtaaacgatggacactaggtgtggggggacgatccctccgtgccgcagccaacgcattaagtgtcccgcctggggagtacggccgcaaggctaaaactcaaaggaattgacgggggcccgcacaagcagcggagcatgtggcttaattcgaagcaacgcgaagaaccttaccagggcttgacatccaggtgaagcggcggaaacgccgtggccggaaggagcctggacaggtggtgcatggctgtcgtcagctcgtgtcgtgagatgttgggttaagtcccgcaacgagcgcaacccccgtcgcatgttgccagcggtccggccgggcacccatgcgagaccgccggcgtcaagccggaggaaggtggggacgacgtcaagtcatcatgccccttatgccctgggctgcacacgtgctacaatggccggcacagcgggccgccaccgcgcgagcgggagcgaatccccaaagccggccccagttcggactggaggctgcaacccgcctccacgaagtcggagttgctagtaatcgcggatcagcacgccgcggtgaatgcgttcccgggccttgtacacaccgcccgtcacaccacccgagtcgtctgcacccgaagtcgtcggcccaacccgcgagggggggaggcgccgaaggtgtggagggtaaggggggtgaagtcgtaacaaggtagccgtaccggaaggtgcggctggatcacct

SEQ ID NO: 1373 - DNA, 1551 bp, Opitutus terrae
agagtttgatcctggctcagaatgaacgctggcggcgtggttaagacatgcaagtcgaacggtttttccggtgtagcaatacatcggaaagacagtggcgaacgggtgcgtaacacgtgaacaatctacctccaaatggggaatagctcggcgaaagccggattaataccgcatgtggttgcttctcgcatgagaggtataccaaagtcggggaccgcaaggcctgacgttaggagaggagttcgcggcctatcagctagttggcgaggtaacggctcaccaaggcaaagacgggtagctggtctgagaggatgatcagccacactggaactgagacacggtccagacacctacgggtggcagcagtttcgaatcattcacaatgggcgaaagcctgatggtgcgacgccgcgtgagggatgaaggtcttcggattgtaaacctctgtcaccggggaagaaacgctttatattaatcgtataaagcctgacttaacccggagaggaagcagtggctaactctgtgccagcagccgcggtaatacagagactgcgagcgttattcggattcactgggcgtaaagggtgcgcaggcggccgggtgtgtggggcgtgaaagcctggagcttaactccagaattgcgcctcaaactacacggctagagcattggagagggtagcggaattcacggtgtagcagtgaaatgcgtagatatcgtgaggaacaccagaggcgaaggcggctacctggacaattgctgacgctcaggcacgaaagcgtggggagcaaaagggattagatacccctgtagtccacgccctaaacggtgcacactaggtcttggcggattcgacccctccagggccccagctaacgcgttaagtgtgccgcctgaggactacggccgcaaggctaaaactcaaaggaattgacgggggcccgcacaagcggtggagtatgtggctcaattcgatgcaacgcgaagaaccttaccaagccttgacatgcattggacaggcgctgaaaggcgccctcccttcggggccggtgcacaggtgctgcatggctgtcgtcagctcgtgtcgtgagatgttgcgttaagtcgcgcaacgagcgcaacccctgtccttagttgccatcattcagttgggcactctagggagacaaaccctctttgagggtgggaaggtggggatgacgtcaagtcaggatggcccttacggcttgggctgcacacgtactacaatgcccggtacagagggacgcaataccgcgaggtggagcaaatcctcaaaaccgggcccagttcagattgtagtctgcaactcgactacatgaagttggaatcgctagtaatggcgcatcagctacggcgccgtgaatacgttcccgggccttgtacacaccgcccgtcacgtcatgaaagccggtttcgcccgaagtgcgtttgccaaccagcaatggaggcggcgccctaaggtgaggctggtgattgggacgaagtcgtaacaaggtagccgtaggggaacctgcggctggatcacctccttt

SEQ ID NO: 1374 - DNA, 1443 bp, Oribacterium sinus
ggaaagcttcggccggaagatacgttatctagtggcggacgggtgagtaacacgtgggtaacctgccttatggagggggataacagagagaaatcactgctaataccgcataagcacacagtaccgcatggtacagggtgaaaagatttatcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtagacggaatggcaagtctgaagtgaaatacccgggctcaacctgggaactgctttggaaactgttgttctagagtgttggagaggtaagtggaattcctggtgtagcggtgaaatgcgtagatatcaggaagaacaccggaggcgaaggcggcttactggacaataactgacgttgaggctcgaaagcgtggggatcaaacaggattagataccctggtagtccacgctgtaaacgatgaatactaggtgtcggggtgcaaagcatctcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgagatcccattgacagagtatgtaatgtactttcccttcggggcaatggtgacaggtggtgcatggttgtcgtcagctcgtgtcgtgagatgttgggttaagtcccgcaacgagcgcaacccctatagttagtagccagcagtaagatgggcactctaactagactgccagggataacctggaggaaggcggggatgacgtcaaatcatcatgccccttatgacttgggctacacacgtgctacaatggcgtaaacaaagggaagcaagagggtgaccttaagcaaatctcaaaaataacgtctcagttcggactgtagtctgcaacccgactacacgaagctggaatcgctagtaatcgcagatcagcatgctgcggtgaatacgttcccgggtcttgtacacaccgcccgtcacaccatgggagttggtaatgcccgaagtcagtgtcccaagaaagggagctgccgaaggcaggactgatgactggggtgaagtcgtaacaaggtagccgtatcggaaggtgcggctggatcacctcctt

SEQ ID NO: 1375 - DNA, 1378 bp, Oribacterium sp.
  ACB1
gatatgttatctagtggcggacgggtgagtaacacgtgggtaacctgccttatggagggggataacagagagaaatcactgctaataccgcataagcacacattgccgcatggcagagtgtgaaaagatttatcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtagacggaatggcaagtctgaagtgaaaaccccgggctcaacctggggactgctttggaaactgttgttctagagtgttggagaggtaagtggaattcctggtgtagcggtgaaatgcgtagatatcaggaagaacaccggaggcgaaggcggcttactggacaataactgacgttgaggctcgaaagcgtggggatcaaacaggattagataccctggtagtccacgctgtaaacgatgaatactaggtgtcggggtgcaaagcatctcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgagatcccattgacagagtgtgtaatgcactttcccttcggggcaatggtgacaggtggtgcatggttgtcgtcagctcgtgtcgtgagatgttgggttaagtcccgcaacgagcgcaacccctatagttagtagccagcagtaagatgggcactctaactagactgccagggataacctggaggaaggcggggatgacgtcaaatcatcatgccccttatgacttgggctacacacgtgctacaatggcgtaaacaaagggaagcaagagggtgaccttaagcaaatctcaaaaataacgtctcagttcggactgtagtctgcaacccgactacacgaagctggaatcgctagtaatcgcagatcagcatgctgcggtgaatacgttcccgggtcttgtacacaccgcccgtcacaccatgggagttggtaatgcccgaagtcagtgttccaaaagaggaagctgccgaaaggcaggactgatgactggggtgaa

SEQ ID NO: 1376 - DNA, 1436 bp, Oribacterium sp.
  ACB7
  modified_base (45)..(45): a, c, t, g, unknown or other
  modified_base (164)..(164): a, c, t, g, unknown or other
gcggcgtgcctaacacatgcaagtcgaacgagatgcgtattgganagcttcggccggaagatgcgttatctagtggcggacgggtgagtaacacgtgggtaacctgccttatggagggggataacagagagaaatcactgctaataccgcataagcacacagtnccgcatggcagagtgtgaaaagatttatcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtagacggagtggcaagtctgaagtgaaaaccctgggcttaacctggggactgctttggaaactgttaatctagagtgttggagaggtaagtggaattcctggtgtagcggtgaaatgcgtagatatcaggaagaacaccggaggcgaaggcggcttactggacaataactgacgttgaggctcgaaagcgtggggatcaaacaggattagataccctggtagtccacgctgtaaacgatgaatactaggtgtcggggagcaaagcttctcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgagatcccattgacagagtgtgtaatgcattttcccttcggggcaatggtgacaggtggtgcatggttgtcgtcagctcgtgtcgtgagatgttgggttaagtcccgcaacgagcgcaacccctatagttagtagccagcagtaagatgggcactctaactagactgccagggataacctggaggaaggcggggatgacgtcaaatcatcatgccccttatgacttgggctacacacgtgctacaatggcgtaaacaaagggaagcaagagggtgaccttaagcaaatctcaaaaataacgtctcagttcggactgtagtctgcaacccgactacacgaagctggaatcgctagtaatcgcagatcagcatgctgcggtgaatacgttcccgggtcttgtacacaccgcccgtcacaccatgggagttggtaatgcccgaagtcagtgtcccaagagagggagctgccgaaggcaggactgatgactggggtgaa

SEQ ID NO: 1377 - DNA, 1372 bp, Oribacterium sp.
  CM12
gctcaggatgaacgctggcggcgtgcctaacacatgcaagtcgaacgagatgcttatcggaaagcttcggccggaagatacgttatctagtggcggacgggtgagtaacacgtgggtaacctgccttatggagggggataacagagagaaatcactgctaataccgcataagcacacagtaccgcatggtacagggtgaaaagatttatcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtagacggaatggcaagtctgaagtgaaatacccgggctcaacctgggaactgctttggaaactgttgttctagagtgttggagaggtaagtggaattcctggtgtagcggtgaaatgcgtagatatcaggaagaacaccggaggcgaaggcggcttactggacaataactgacgttgaggctcgaaagcgtggggatcaaacaggattagataccctggtagtccacgctgtaaacgatgaatactaggtgtcggggtgcaaagtatctcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgagatcccattgacagagtatgtaatgtactttcccttcggggcaatggtgacaggtggtgcatggttgtcgtcagctcgtgtcgtgagatgttgggttaagtcccgcaacgagcgcaacccctatagttagtagccagcagtaagatgggcactctaactagactgccagggataacctggaggaaggcggggatgacgtcaaatcatcatgccccttatgacttgggctacacacgtgctacaatggcgtaaacaaagggaagcaagagggtgaccttaagcaaatctcaaaaataacgtctcagttcggactgtagtctgcaacccgactacacgaagctggaatcgctagtaatcgcagatcagcatgctgcggtgaatacgttcccgggtcttgtacacaccgcccgtc

SEQ ID NO: 1378 - DNA, 1425 bp, Oribacterium sp.
  ICM51
caggatgaacgctggcggcgtgcctaacacatgcaagtcgaacgagatgcgtatcggaaagcttcggccggaagatacgttatctagtggcggacgggtgagtaacacgtgggtaacctgccttatggagggggataacagagagaaatcactgctaataccgcataagcacacagtaccgcatggtacagggtgaaaagatttatcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtagacggaatggcaagtctgaagtgaaatacccgggctcaacctgggaactgctttggaaactgttgttctagagtgttggagaggtaagtggaattcctggtgtagcggtgaaatgcgtagatatcaggaagaacaccggaggcgaaggcggcttactggacaataactgacgttgaggctcgaaagcgtggggatcaaacaggattagataccctggtagtccacgctgtaaacgatgaatactaggtgtcggggtgcaaagcatctcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgagatcccattgacagagtatgtaatgtactttcccttcggggcaatggtgacaggtggtgcatggttgtcgtcagctcgtgtcgtgagatgttgggttaagtcccgcaacgagcgcaacccctatagttagtagccagcagtaagatgggcactctaactagactgccagggataacctggaggaaggcggggatgacgtcaaatcatcatgccccttatgacttgggctacacacgtgctacaatggcgtaaacaaagggaagcaagagggtgaccttaagcaaatctcaaaaataacgtctcagttcggactgtagtctgcaacccgactacacgaagctggaatcgctagtaatcgcagatcagcatgctgcggtgaatacgttcccgggtcttgtacacaccgcccgtcacaccatgggagttggtaatgcccgaagtcagtgtcccaagaaagggagctgccga

SEQ ID NO: 1379 - DNA, 1259 bp, Oribacterium sp.
  OBRC12
tcaggatgaacgctggcggcgtgcctaacacatgcaagtcgaacgagtggcggacgggtgagtaacacgtgggtaacctgccttatggagggggataacagagagaaatcactgctaataccgcataagaaaagtcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagatgacagtacctgactaagaagccccggctaactacgtgccagcagccgcggtaatacgtagggggcaagcgttatccggatttactgggtgtaaagggagcgtagacggaatggcaagtctgaagtgaaatacccgggctcaacctgggaactgctttggaaactgttgttctagagtgttggagaggtaagtggaattcctggtgtagcggtgaaatgcgtagatatcaggaagaacaccggaggcgaaggcggcttactggacaaactgacgttgaggctcgaaagcgtggggatcaaacaggattagataccctggtagtccacgctgtaaacgatgaatactaggtgtcggggtctcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgagatcgacaggtggtgcatggttgtcgtcagctcgtgtcgtgagatgttgggttaagtcccgcaacgagcgcaacccctatagttagtagccagcatgggcactctaactagactgccagggataacctggaggaaggcggggatgacgtcaaatcatcatgccccttatgacttgggctacacacgtgctacaatggcgtacaaagggaagcaagagggtgaccttaagcaaatctcaaaacgtctcagttcggatgtagtctgcaacccgactacagaagctggaatcgctagtaatcgcagatcagcatgctgcggtgaatacgttcccgggtcttgtacacaccgcccgtcacaccatgggagttggtaatgcccgaagtcagt

SEQ ID NO: 1380 - DNA, 1523 bp, Oribacterium sp.
  oral taxon 078
aatgagagttcgatcctggctcaggatgaacgctggcggcgtgcctaacacatgcaagtcgaacggagtccagcctttaagaccttcgggtcaaagaggggaagactgagtggcggacgggtgagtaacacgtgggcaacctggctcatagagggggataacagagagaaatttctgctaataccgcataagcacacactgccacatggcagagggtgaaaagagaatcgctatgagatggacccgcgtctgattagccagttggcagggtaagagcctaccaaagcgacgatcagtagccgatctgagaggatgaacggccacattgggactgagacacggcccaaactcctacgggaggcagcagtgggggatattgcacaatggggggaaccctgatgcagcgacgccgcgtgagtgaagaagtatttcggtatgtaaagctctatcagcagggaagataatgacagtacctgaataagaagccccggctaactacgtgccagcagccgcggtaatacgtagggggcaagcgttatccggatttactgggtgtaaagggagcgtagacggaatggcaagtctgaagtgaaatgcccgggctcaacccgggaactgctttggaaactgtcgatctggagtgttggagaggtaagtggaattcctggtgtagcggtgaaatgcgtagagatcaggaagaacaccggaggcgaaggcggcttactggacaaagactgacgttgaggctcgaaagcgtgggaagcaaacaggattagataccctggtagtccacgccgtaaacgatgaatactaggtgtcggtctccgaaggagatcggtgccgacgcaaacgcaataagtattccacctggggagtacgttcgcaagaatgaaactcaaaggaattgacggggacccgcacaagcggtggagcatgtggtttaattcgaagcaacgcgaagaaccttaccaggtcttgagatcccgatgacagaagatgtaatgccttttcccttcggggcattggagacaggtggtgcatggttgtcgtcagctcgtgtcgtgagatgttgggttaagtcccgcaacgagcgcaacccttatcgtcagtagccagcagtaagatgggcactctgatgagactgccggggataacccggaggaaggcggggatgacgtcaaatcatcatgccccttatgacctgggcgacacacgtgctacaatggcggaaacagagggaagcgagggggcgacccggagcaaatctcaaaaataccgtctcagttcggactgcagtctgcaactcgactgcacgaagccggaatcgctagtaatcgcggatcagcatgccgcggtgaatccgttcccgggtcttgtacacaccgcccgtcacaccatgggagtcggtaatgcccgaagtcagtgacccaaaagagggagctgccgaaggcaggacagataactggggtgaagtcgtaacaaggtagccgtatcggaaggtgcggctggatcacctcctttct

SEQ ID NO: 1381 - DNA, 1497 bp, Oribacterium sp.
  oral taxon 102
gagtttgatcctggctcaggatgaacgctggcggcgtgcctaacacatgcaagtcgaacggggttctatatcggaagttttcggatggaagagataggacccagtggcggacgggtgagtaacacgtgggtaacctgcctcatagagggggataacagagagaaatcactgctaataccgcataagcacacgggatcgcatgatcctgggtgaaaagatttatcgctatgagatggactcgcgtctgattagctggttggcggggtaaaggcccaccaaggcgacgatcagtagccgatctgagaggatggccggccacattgggactgagacacggcccagactcctacgggaggcagcagtgggggatattgcacaatggagggaactctgatgcagcaacgccgcgtgagtgaagaagtatttcggtatgtaaagctctatcagcagggaagatgatgacagtacctgaataagaagccccggctaactacgtgccagcagccgcggtaatacgtagggggcaagcgttatccggatttactgggtgtaaagggagcgtagacggcgaagcaagtctgaagtgaaaatccggggctcaactccggaagtgctttggaaactgttttgatagagtgtcggagaggtaagtggaattcctggtgtagcggtgaaatgcgtagatatcaggaagaacaccggaggcgaaggcggcttactggacgataactgacgttgaggctcgaaagcgtgggaagcaaacaggattagataccctggtagtccacgccgtaaacgatgaatactaggtgtcgggggcgaagcccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccattgacagagcatgtaatgtgctttcccctcggggcaatggagacaggtggtgcatggttgtcgtcagctcgtgtcgtgagatgttgggttaagtcccgcaacgagcgcaacccctatattcagtagccagcagtaagatgggcactctggagagactgccagggataacctggaggaaggcggggatgacgtcaaatcatcatgccccttatgacttgggcgacacacgtgctacaatggcgtaaacaaagggaagcgagctcgcgagagtaagcgaaactcaaaaataacgtctcagttcggactgtagtctgcaacccgactacacgaagctggaatcgctagtaatcgcagatcagcatgctgcggtgaatacgttcccgggtcttgtacacaccgcccgtcacaccatgggagtcggtaatgcccgaagccagtgaaccaagagagggagctgtcgaaggcaggactgataactggggtgaagtcgtaacaaggtagccgtatcggaaggtgc

SEQ ID NO: 1382 - DNA, 1527 bp, Oribacterium sp.
  oral taxon 108
tttattatgagagttcgatcctggctcaggatgaacgctggcggcgtgcctaacacatgcaagtcgaacgagatgcgtatcggaaagcttcggccggaagatacgttatctagtggcggacgggtgagtaacacgtgggtaacctgccttatggagggggataacagagagaaatcactgctaataccgcataagcacacattgccgcatggcagagtgtgaaaagatttatcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtagacggaatggcaagtctgaagtgaaaaccctgggctcaacctggggactgctttggaaactgttgttctagagtgttggagaggtaagtggaattcttggtgtagcggtgaaatgcgtagatatcaggaagaacaccggaggcgaaggcggcttactggacaataactgacgttgaggctcgaaagcgtggggatcaaacaggattagataccctggtagtccacgctgtaaacgatgaatactaggtgtcggggagcaaagcatctcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgagatcccattgacagagtgtgtaatgcattttcccttcggggcaatggtgacaggtggtgcatggttgtcgtcagctcgtgtcgtgagatgttgggttaagtcccgcaacgagcgcaacccctatagttagtagccagcagtaagatgggcactctaactagactgccagggataacctggaggaaggcggggatgacgtcaaatcatcatgccccttatgacttgggctacacacgtgctacaatggcgtaaacaaagggaagcaagagggtgaccttaagcaaatctcaaaaataacgtctcagttcggactgtagtctgcaacccgactacacgaagctggaatcgctagtaatcgcagatcagcatgctgcggtgaatacgttcccgggtcttgtacacaccgcccgtcacaccatgggagttggtaatgcccgaagtcaatgttccaagagaggaagctgccgaaggcaggactgatgactggggtgaagtcgtaacaaggtagccgtatcggaaggtgcggctggatcacctcctttct

SEQ ID NO: 1383 - DNA, 1506 bp, Orientia tsutsugamushi
tcaaacttaagagtttgatcctggctcagaacgaacgctggcggcatgcctaacacatgcaagtcgaacgaattaatgctgagcttgcttagcattaattagtggcaaacgggtgagtaacacgtgggaatctgcccatcagtacggaataacatttagaaataagtgctaataccgtatgccctctacaaggaggaaagatttatcgctgatggatgagcccgcggcagattaggtagttggtaaggtaatggcttaccaagcctgtgatctgtagctggtctgagaggacgaacagccacactgggactgagacacggcccagactcctacggggggcagcagtggggaatattggacaatgggcgaaagcctgatccagcaatgccgcgtgagtgatgaaggccttagggttgtaaagctcttttagtagggatgataatgacagtacctacagaaaaagccccggctaactccgtgccagcagccgcggtaagacggagggggctagcgttgttcggaattactgggcgtaaagggcgcgtaggcggtttaataagttaggagtgaaatcccggggcttaaccctggaactgcttctaaaactgttaggctagagtgtggtagaggatgatggaatttctagtgtagaggtaaaattcttagatattagaaggaacaccagtggcgaaagctgtcatctgggccattactgacgctgaggcgcgaaagcgtggggagcaaacaggattagataccctggtagtccacgctgtaaacgatgagtgctagatattgggggatttttctttcagtttcgtagctaacgcattaagcactccgcctggggagtacggtcgcaagattaaaactcaaaggaattgacgggggcccgcacaagcggtggagcatgcggtttaattcgatgatccgcgaaaaaccttaccaactcttgacatggtagtcgcgaaaaatggagacatttttcttcagtttggctggactacacacaggtgttgcatggctgtcgtcagctcgtgtcgtgagatgttgggttaagtcccgcaacgagcgcaacccttattcttatttgccagcgggtaatgccgggaactataggaaaactgccggtgctaagccggaggaaggtggggatgaggtcaagtcatcatggcccttatgagttgggctacacgcgtgctacaatggtacctacagaatgatgcaatacggtaacgtggagctaatcattaaaaggtatctcagttcggattgcactctgcaactcgagtgcatgaagtcggaatcgctagtaatcgcggatcagcatgccgcggtgaatacgttctcgggccttgtacacactgcccgtcgcaccatgggagtcagtggtacctgaagttggtgagctaacgtaagaggcagctaaccacggtagaactggtgactggggtaaagtcgtaacaaggtagccgtaggggaacctgcggctggattacctccttt

SEQ ID NO: 1384 - DNA, 1451 bp, Ornithinibacillus bavariensis
ccttcggggtgaaagtagtggatcgagcggcggacgggtgagtaacacgtgggcaacctgcctgtaagactgggataactcgcggaaacgcgagctaataccggataatactttttatcacatggtaagaagatgaaaggcggcgtaagctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggattgtaaaactctgttgttagggaagaacaagtacaagagtaactgcttgtaccttgacggtacctaaccagaaagccccggctaactacgtgccagcagccgcggtaatacgtagggggcgagcgttgtccggaattattgggcgtaaagcgcgcgcaggcggttctttaagtctgatgtgaaagcccacggcttaaccgtggagggtcattggaaactggaggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggccgcacaagcggtggagcatgtggtttaattcgaagcaacgcgaagaaccttaccaggtcttgacatcctctgaccaccctagagatagggctttcccttcggggacagagagacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgcctaaggtgggaccaatgattggggtgaagtcgtaacaaggtagccgtgtcga

SEQ ID NO: 1385 - DNA, 1504 bp, Ornithinibacillus sp.
  7-10AIA
tggctcaggacgaacgctggcggcgtgcctaatacatgcaagtcgagcgagtgaaattaactgatcccttcggggtgacgttaatggatctagcggcggacgggtgagtaacacgtgggcaacctgcctgtaagactgggataactcgcggaaacgtgagctaataccggataacacttcgaaccacatggtttgaagatgaaaggcggcgcaagctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggattgtaaaactctgttgttagggaagaacaagtacaatagtaactgattgtaccttgacggtacctaaccagaaagccccggctaactacgtgccagcagccgcggtaatacgtagggggcaagcgttgtccggaattattgggcgtaaagcgcgcgcaggcggtcctttaagtctgatgtgaaagcccacggcttaaccgtggagggtcattggaaactggaggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgaccaccctagagatagggctttcccttcggggacagagtgacaggtggtgcatggttgtcgtcagctcgtgtcgtgagatgttgggttaagtcccgcaacgagcgcaacccttattcttagttgccagcatttagttgggcactctaaggagactgccggtgacaaaccggaggaaggtggggatgacgtcaaatcatcatgccccttatgacctgggctacacacgtgctacaatggatggtacaaagggcagcaaaaccgcgaggtcgagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgcctaaggtgggaccaatgattggggtgaagtcgtaacaa

SEQ ID NO: 1386 - DNA, 1420 bp, Oscillibacter sp.
  G2
  modified_base (72)..(72): a, c, t, g, unknown or other
ggacctggctcaggacgaacgctggcggcgtgcttaacacatgcaagtcgaacggagcacccttgaatgagntttcggycaaaggaaaggaatgcttagtggcggactggtgagtaacgcgtgaggaacctgcctttcagagggggacaacagctggaaacggctgctaataccgcatgacgcattcggatggcatcatctgaatgccaaagatttatcgctgaaagatggcctcgcgtctgattagatagttggcggggtaacggcccaccaagtcgacgatcagtagccggactgagaggttgaccggccacattgggactgagatacggcccagactcctacgggaggcagcagtggggaatattgggcaatgggcgcaagcctgacccagcaacgccgcgtgaaggaagaaggctttcgggttgtaaacttcttttaagagggaagagcagaagacggtacctcttgaataagccacggctaactacgtgccagcagccgcggtaatacgtaggtggcaagcgttgtccggatttactgggtgtaaagggcgtgcagccgggtgygcaagtcagatgtgaaatctcagggctcaaccctgaaactgcatttgaaactgtgygtcttgagtgccggagaggtaatcggaattccttgtgtagcggtgaaatgcgtagatataaggaagaacaccagtggcgaaggcggattactggacggtaactgacggtgaggcgcgaaagcgtggggagcaaacaggattagataccctggtagtccacgctgtaaacgatcaatactaggtgtgcggggactgaccccctgcgtgccggagttaacacaataagtattgcacctggggagtacgatcgcaaggttgaaactcaaaggaattgacgggggcccgcacaagcggtggattatgtggtttaattcgaagcaacgcgagaaccttaccaggtcttgacatcctgctacgagtagagatacatcaggtgcccttcggggaaagcagagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgacctgggctacacacgtaatacaatggcggagaacaaagggatgcaaagccgcgaggcagagcgaaccccaaaaagccgtcccagttcggatcgcaggctgcaacccgcctgcgtgaagtcggaatcgctagtaatcgtgggtcagcataccacggtgaatacgttcccgggccttgtacacaccgcccgtcacaccatgagagtcgggaacacccgaagtccgtagcctaacc

SEQ ID NO: 1387 - DNA, 1534 bp, Oscillibacter valericigenes
atttatagagagtttgatcctggctcaggacgaacgctggcggcgtgcttaacacatgcaagtcgaacggagcacccttgattgaggtttcggccaaatgagaggaatgcttagtggcggactggtgagtaacgcgtgaggaacctgcctttcagagggggacaacagttggaaacgactgctaataccgcatgatacatttgggcgacatcgcttgaatgtcaaagatttatcgctgaaagatggcctcgcgtctgattagatagttggtgaggtaacggcccaccaagtcgacgatcagtagccggactgagaggttgaccggccacattgggactgagatacggcccagactcctacgggaggcagcagtggggaatattgggcaatggacgcaagtctgacccagcaacgccgcgtgaaggaagaaggctttcgggttgtaaacttcttttaagggggaagagtagaagacggtaccccttgaataagccacggctaactacgtgccagcagccgcggtaatacgtaggtggcaagcgttgtccggatttactgggtgtaaagggcgtgtagccgggaaggtaagtcagatgtgaaatctgggggctcaacctccaaactgcatttgaaactacttttcttgagtatcggagaggtaatcggaattccttgtgtagcggtgaaatgcgtagatataaggaagaacaccagtggcgaaggcggattactggacgacaactgacggtgaggcgcgaaagcgtggggagcaaacaggattagataccctggtagtccacgctgtaaacgatcaatactaggtgtgcggggactgaccccctgcgtgccgcagttaacacaataagtattgcacctggggagtacgatcgcaaggttgaaactcaaaggaattgacgggggcccgcacaagcggtggattatgtggtttaattcgaagcaacgcgaagaaccttaccaggacttgacatcctactaacgaggtagagatacgtcaggtgcccttcggggaaagtagagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggctacacacgtaatacaatggcggtcaacagagggatgcaaagccgtgaggtggagcgaacccctaaaagccgtctcagttcggatcgcaggctgcaactcgcctgcgtgaagtcggaatcgctagtaatcgcggatcagaatgccgcggtgaatacgttcccgggccttgtacacaccgcccgtcacaccatgagagtcgggaacacccgaagtccgtagcctaacagcaatgagggcgcggccgaaggtgggtttgataattggggtgaagtcgtaacaaggtagccgtatcggaaggtgcggctggatcacctcctttcta

SEQ ID NO: 1388 - DNA, 1450 bp, Oscillospira guilliermondii
gacgaacgctggcggcgtgcttaacacatgcaagtcgaacggagcgccaaggaaggagttttcggacaacggatttggctgcttagtggcggactggtgagtaacgcgtgaggaacctgcccttgagtgggggacaacggttggaaacgactgctaataccgcatgatgtattgtcgggacatcccggcgataccaaagatttatcgctcaaggatggcctcgcgtctgattagatagttggtgaggtaacggctcaccaagtcgacgatcagtagccggactgagaggttggccggccacattgggactgagatacggcccagactcctacgggaggcagcagtggggaatattgggcaatggacgcaagtctgacccagcaacgccgcgtgaaggaagaaggctttcgggttgtaaacttcttttaagggggaagagcagaagacggtaccccttgaataagccacggctaactacgtgccagcagccgcggtaatacgtaggtggcgagcgttgtccggatttactgggtgtaaagggcgtgcagccgggtctgcaagtcagatgtgaaatccacgggcttaacccgtgaactgcatttgaaactgcgggtcttgagtatcggagaggtaatcggaattcctggtgtagcggtgaaacgcgtagatatcaggaagaacaccagtggcgaaggcggattactggacgacaactgacggtgaggcgcgaaagcgtggggagcaaacaggattagataccctggtagtccacgctgtaaacgatcaatactaggtgtgcggggactaacccctcgcgtgccggagtcaacacaataagtattgcacctggggagtacgatcgcaaggttgaaactcaaaggaattgacgggggcccgcacaagcggtggattatgtggtttaattcgaagcaacgcgaagaaccttaccaaggcttgacatggagaggctcggcttagagataggtctttcccttcggggacttctcacacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcttgggctacacacgtaatacaatggcggatacaaagggatgcgaaaccgcgaggtggagcgaaccccgaaaagccgtctcagttcggatcgcaggctgcaacccgcctgcgtgaagtcggaatcgctagtaatcgtgggtcagcataccacggtgaatacgttcccgggccttgtacacaccgcccgtcacaccatgagagtcgggaacacccgaagtccgtagcctaaccgcaaggggggcgcggccgaaggtgggttcgataattggggtg

SEQ ID NO: 1389 - DNA, 1539 bp, Oxalobacter formigenes
tgaactgaagagtttgatcctggctcagattgaacgctggcggcatgctttacacatgcaagtcgaacggcagcatgggggcaaccctgatggcgagtggcgaacgggtgagtaatatatcggaacgtacccaagagtgggggacaaccagtcgaaagattggctaataccgcatacgatctaaggatgaaagtgggggaccttcgggcctcacgctcctggagcggccgatagctgattagctagttggtggggtaaaggcctaccaaggcgatgatcagtagctggtctgagaggacgatcagccacactgggactgagacacggcccagactcctacgggaggcagcagtggggaattttggacaatgggggaaaccctgatccagcaatgccgcgtgagtgaagaaggccttcgggttgtaaagctcttttgtcagggaagaaattgattgggctaatatcccgattagatgacggtacctgaagaataagcaccggctaactacgtgccagcagccgcggtaatacgtagggtgcgagcgttaatcggaattactgggcgtaaagcgtgcgcaggcggttgtgtaagacagatgtgaaatgcccgggctcaacctgggaattgcatttgtgactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtcgactagttgttgggtcttaattgacttagtaacgcagctaacgcgtgaagtcgaccgcctggggagtacggtcgcaagattaaaactcaaaggaattgacggggacccgcacaagcggtggatgatgtggattaattcgatgcaacgcgaaaaaccttacctacccttgacatgtcaggaatcccgaagagatttgggagtgctcgaaagagagcctgaacacaggtgctgcatggctgtcgtcagctcgtgtcgtgagatgttgggttaagtcccgcaacgagcgcaacccttgtcattagttgctacgaaagggcactctaatgaaactgccggtgacaaaccggaggaaggtggggatgacgtcaagtcctcatggcccttatgggtagggcttcacacgtcatacaatggtgcatacagagggttgccaacccgagagggggagctaatctcagaaagtgcatcgtagtccggattgaagtctgcaactcgacttcatgaagttggaatcgctagtaatcgcggatcagcatgtcgcggtgaatacgttcccgggtcttgtacacaccgcccgtcacaccatgggagcgggttttaccagaagtaggtagcttaaccgtaaggagggcgcttaccacggtaggattcgtgactggggtgaagtcgtaacaaggtagccgtatcggaaggtgcggctggatcacctcctttctagaga

SEQ ID NO: 1390 - DNA, 1523 bp, Paenibacillus barcinonensis
aacgctggcggcatgcctaatacatgcaagtcgagcggacttgaagagaagcttgcttctctgatggttagcggcggacgggtgagtaacacgtaggcaacctgccctcaagcttgggacaactaccggaaacggtagctaataccgaatacttgttttcttcgcctgaagagaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgggtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccaactaacgaggtagagatacgttaggtgcccttcggggaaagttgagacaggtggtgcatggttgtcgtcagctcgtgtcgtgagatgttgggttaagtcccgcaacgagcgcaacccttgatcttagttgccagcatttcggatgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcttt

SEQ ID NO: 1391 - DNA, 931 bp, Paenibacillus barengoltzii
  modified_base (891)..(891): a, c, t, g, unknown or other
gcggagtttatcgggagcttgctcctgataaacttagcggcggacgggtgagtaacacgtaggcaacctgcccgtaagactgggataactaccggaaacggtagctaataccggatacgcaagtctctcgcatgaggggcttgggaaaggcggagcaatctgtcacttacggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccgttagagtaactgctaacggagtgacggtacctgagaagaaagccccggctaactacgtgccagcagccgcggtaatacgtagggggcgagcgttgtccggaattattgggcgtaaagcgcgcgcaggcggctgtttaagtctggtgtttaatcctggggctcaaccccgggtcgcactggaaactggacagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggccgcaaggctgaaactcaaaggaattgacggggacccgcacaagcagtggngtatgtggtttaattcgaagcaacgcgaagaaccttacca

SEQ ID NO: 1392 - DNA, 968 bp, Paenibacillus chibensis
gcggacttgatggagagcttgctctcctgatggttagcggcggacgggtgagtaacacgtaggcaacctgcctgcaagaccgggataacccacggaaacgtgagctaataccggatatctcatttcctctcctgagggaatgatgaaagacggagcaatctgtcacttgcggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctatcggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaggccaaggctcaaccttggttcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagacc

SEQ ID NO: 1393 - DNA, 1408 bp, Paenibacillus cookii
  modified_base (8)..(8): a, c, t, g, unknown or other
cggagttngttttgaaagcttgctttcaaaacaacttagcggcggacgggtgagtaacacgtaggcaacctgccccttagactgggataactaccggaaacggtagctaataccggataatttcttttttctcctgaaggaagaatgaaagacggagcaatctgtcactgagggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaaccttgggctcaacctaaggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgaggggacccgcacaagcagtggagtatgtggtttaattcgaagcaacgcgaagaaccttaccaggtcttgacatccctctgaatccactagagatagtggcggccttcgggacagaggagacaggtggtgcatggttgtcgtcagctcgtgtcgtgagatgttgggttaagtcccgcaacgagcgcaacccttaactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccatcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagc

SEQ ID NO: 1394 - DNA, 1455 bp, Paenibacillus durus
  modified_base (103)..(103): a, c, t, g, unknown or other
  modified_base (141)..(142): a, c, t, g, unknown or other
agcggcggacgggtgagtaacacgtaggcaacctgccccttggactgggataactaccggaaacggtagctaataccggataattcctcttagctcctgctangaggctgaaaggcggagcaatctgtcaccaagggatgnncctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctgtttaagtctggtgtttaaaccatgggctcaacctgtggtcgcactggaaactggacagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatcgtctagagatgatggcgcggccttcgggacagaggagacaggtggtgcatggttgtcgtcagctcgtgtcgtgagatgttgggttaagtcccgcaacgagcgcaacccttgactttagttgccagcaggtcaagctgggcactctagagtgactgccgagtgacaaaccggaggaaggtggggatgacgtcaaatcatcatgccccttatgacctgggctacacacgtactacaatggccggtacaacgggaagcgaagcgcgaggcgggagccaatcttagaaagccggtctcagttcggattgcaggctgcaactcgcctgcatgaagtcggaattgctagctaatcgcggatcagcatgccgcggtgcaatgacgttcccgggtcttgtacacaccgcccgtcacaccacgagagtttacaacacccgaagtcggtggggtaaccgcaaggagccagccgccgaagtggggtagatgattggggtgaagtcgtaacaaggtagccgtatcggaaggtgcggctggatcacctcc

SEQ ID NO: 1395 - DNA, 1440 bp, Paenibacillus glucanolyticus
  modified_base (179)..(179): a, c, t, g, unknown or other
  modified_base (198)..(198): a, c, t, g, unknown or other
  modified_base (446)..(446): a, c, t, g, unknown or other
  modified_base (532)..(532): a, c, t, g, unknown or other
  modified_base (535)..(535): a, c, t, g, unknown or other
  modified_base (595)..(595): a, c, t, g, unknown or other
  modified_base (597)..(597): a, c, t, g, unknown or other
  modified_base (729)..(729): a, c, t, g, unknown or other
  modified_base (818)..(818): a, c, t, g, unknown or other
  modified_base (902)..(902): a, c, t, g, unknown or other
  modified_base (953)..(953): a, c, t, g, unknown or other
  modified_base (966)..(966): a, c, t, g, unknown or other
  modified_base (1072)..(1072): a, c, t, g, unknown or other
  modified_base (1125)..(1125): a, c, t, g, unknown or other
  modified_base (1363)..(1363): a, c, t, g, unknown or other
  modified_base (1400)..(1400): a, c, t, g, unknown or other
gagagtttgatcctggctcaggacgaacgctggcggcgtgcctaatacatgcaagtcgagcggacttgatggagtgcttgcactcttgagagttagcggcggacgggtgagtaacacgtaggcaacctgccctcaagactgggataactaccggaaacggtagctaataccggataatntattacatagcattatgtnataatgaaagacggagcaatctgtcacttggggatgggcctgcggcgcattagctagttggtggggtaacggcccaccaaggcgacgatgcgtagccgacctgagagggtgaacggccacactgggactgagacacggcccagtctcctacgggaggcagcagtagggaatcttccgcaatgggcgaaaaactgacggagcaacgccgcgtgagtgatgaaggttttcggatcgtaaagctctgttgncaaggaagaacgtcttctagagtaactgttatgagagtgacggtacttgagaagaaagccccggctaactacgtgccagcagccgnggnaatacgtagggggcaagcgttgtccggaattattgggcgtaaagcgcgcgcaggcggtcntntaagtctggtgtttaaacccggggctcaacttcgggtcgcactggaaactgggggacttgagtgcagaagaggagagtggaattccacgtgtagcggtgaaatgcgtagatatgtggaggaacaccagtggngaaggcgactctctgggctgtaactgacgctgaggcgcgaaagcgtggggagcaaacaggattagataccctggtagtccacgccgttnaaacgatgaatgctaggtgttaggggtttcgatacccttggtgccgaagttaacacattaagcattccgcctggggagtacggncgcaagcactgaaactcaaaggaattgacggggacccgcacaagcagtggngtatgtggtttanttcgaagcaacgcgaagaaccttaccaagtcttgacatccctctgaatctgctagagatagaggcggccttcgggacagaggagacaggtggtgcatggttgtcgncagctcgtgtcgtgagatgttgggttatgtcccgcaacgagcgcaacccttgnttttagttgccagcactaagggtgggcactctagaatgactgccggtgacaaaccggaggaaggcggcgtatgacgtcaaatcatcatgccccttatgacttgggctacacacgtactacaatggctggtacaacgggaagcgaagccgcgaggtggagccaatcctataaaagccagtctcagctcggattgcaggctgcaactcgcctgcatgaagtcggaattgctagtaatcgnggatcagcatgccgcggtgaatacgttcccgggtctngtacacaccgcccgtcacaccacgagagtttacaacaccc

SEQ ID NO: 1396 - DNA, 1395 bp, Paenibacillus lactis
ggagtgcttgcactcctgagatttagcggcggacgggtgagtaacacgtaggcaacctgccctcaagactgggataactaccggaaacggtagctaataccggataggatatttggctgcatggccgaatatggaaaggcggagcaatctgtcacttgaggatgggcctgcggcgcattagctagttggtggggtaatggcctaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgccagagagagtaactgctctttgggtgacggtacctgagaagaaagccccggctaactacgtgccagcagccgcggtaatacgtagggggcaagcgttgtccggaattattgggcgtaaagcgcgcgcaggcggttctttaagtctggtgtttaaacccggagcttaacttcgggacgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaagcttaccaggtcttgacatccctttgacccctctagagatagaggtttccttcgggacagaggagacaggtggtgcatggttgtcgtcagctcgtgtcgtgagatgttgggttaagtcccgcaacgagcgcaacccttgatcttagttgccagcacgtaatggtgggcactctaaggtgactgccggtgacaaaccggaggaaggtggggatgacgtcaaatcatcatgccccttatgacctgggctacacacgtactacaatggctggtacaacgggaagcgaagccgcgaggtggagccaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggagcca

SEQ ID NO: 1397 - DNA, 1505 bp, Paenibacillus lautus
  modified_base (1118)..(1118): a, c, t, g, unknown or other
cgaacgctggcggcgtgcctaatacatgcaagtcgagcggacttgatggagtgcttgcactcctgaaggttagcggcggacgggtgagtaacacgtaggcaacctgccctcaagactgggataactaccggaaacggtagctaataccggataatttatttcacagcattgtggaataatgaaagacggagcaatctgtcacttggggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtcttctagagtaactgctaggagagtgacggtacttgagaagaaagccccggctaactacgtgccagcagccgcggtaatacgtagggggcaagcgttgtccggaattattgggcgtaaagcgcgcgcaggcggttctttaagtctggtgtttaaacccgaggctcaacttcgggtcgcactggaaactgggggacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatcctctagagatagaggcggccttcgggacagaggtgacaggtggtgcatggttgtcgtcagctcgtgtcgtgagatgttgggttaagtcccgcaacgagcgcaacccttgattttagttgccagcacttngggtgggcactctagaatgactgccggtgacaaaccggaggaaggcggggatgacgtcaaatcatcatgccccttatgacttgggctacacacgtactacaatggctggtacaacgggaagcgaagccgcgaggtggagccaatcctataaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaagg

SEQ ID NO: 1398 - DNA, 1500 bp, Paenibacillus pabuli
  modified_base (77)..(77): a, c, t, g, unknown or other
gatcctggctcaggacgaacgctggcggcatgcctaatacatgcaagtcgagcggagttgagagaaagcttgctttnttgatacttagcggcggacgggtgagtaacacgtaggcaacctgccctcaagtttgggacaactaccggaaacggtagctaataccgaatagttgttttcttcgcctgaagagaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaag

SEQ ID NO: 1399 - DNA, 1491 bp, Paenibacillus polymyxa
gacgaacgctggcggcgtgcctaatacatgcaagtcgagcggggttaattagaagcttgcttctaactaacctagcggcggacgggtgagtaacacgtaggcaacctgcccacaagactgggataactaccggaaacggtagctaatacccgatgcctccttttcctgcatgggagaaggaggaaaggcggagcaatctgtcacttgtggatgggcctgcggcgcattagctagttggtggggtaaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagataggacctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagagcgaaggagcgatctggagccaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaa

SEQ ID NO: 1400 - DNA, 968 bp, Paenibacillus popilliae
  modified_base (51)..(52): a, c, t, g, unknown or other
  modified_base (54)..(54): a, c, t, g, unknown or other
  modified_base (59)..(59): a, c, t, g, unknown or other
  modified_base (112)..(112): a, c, t, g, unknown or other
  modified_base (114)..(114): a, c, t, g, unknown or other
cccggctaactacgtgccagcagccgcggtaatacgtagggggcaagcgtnntncgganttattgggcgtaaagcgcgcgcaggcggtcatttaagtctggtgtttaaaccntngggctcaacctaaggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatccactagagatagtggcggccttcgggacagaggagacaggtggtgcatggttgtcgtcagctcgtgtcgtgagatgttgggttaagtcccgcaacgagcgcaacccttaactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccatcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccg

SEQ ID NO: 1401 - DNA, 1496 bp, Paenibacillus sp.
  CIP 101062
tacatgcaagtcgagcggagttaatcgggagcttgctcctggttgacttagcggcggacgggtgagtaacacgtaggcaacctgcccgtaagaccgggataactagcggaaacgttagctaataccggataatcaagtttctcgcatgggggacttgggaaaggcggagcaatctgtcacttacggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgaagaaggttttcggatcgtaaagctctgttgccagggaagaacgtccgctagagtaactgctagcggagtgacggtacctgagaagaaagccccggctaactacgtgccagcagccgcggtaatacgtagggggcaagcgttgtccggaattattgggcgtaaagcgcgcgcaggcggctatttaagtctggtgtttaatcctggggctcaaccccgggtcgcactggaaactgggtggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccccctgaccggtacagagatgtacctttccttcgggacaggggagacaggtggtgcatggttgtcgtcagctcgtgtcgtgagatgttgggttaagtcccgcaacgagcgcaacccttgactttagttgccagcaggtcaagctgggcactctagagtgactgccggtgacaaaccggaggaaggtggggatgacgtcaaatcatcatgccccttatgacctgggctacacacgtactacaatggctggtacaacgggaagcgaaggagcgatccggagcgaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggttggatcacc

SEQ ID NO: 1402 - DNA, 965 bp, Paenibacillus sp.
  HGF5
  modified_base (913)..(913): a, c, t, g, unknown or other
ggagtgcttgcactcctgagatttagcggcggacgggtgagtaacacgtaggcaacctgccctcaagactgggataactaccggaaacggtagctaataccggataggatatttggctgcatggccgaatatggaaaggcggagcaatctgtcacttgaggatgggcctgcggcgcattagctagttggtggggtaatggcctaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgccagagagagtaactgctctttgggtgacggtacctgagaagaaagccccggctaactacgtgccagcagccgcggtaatacgtagggggcaagcgttgtccggaattattgggcgtaaagcgcgcgcaggcggttctttaagtctggtgtttaaacccggagcttaacttcgggacgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaancttaccaggtcttgacatccctttgacccctctagagatagaggtttccttc

SEQ ID NO: 1403 - DNA, 1556 bp, Paenibacillus sp.
  HGF7
ttatcggagagtttgatcctggctcaggacgaacgctggcggcgtgcctaatacatgcaagtcgagcggacttgatgagaagcttgcttctctgagagttagcggcggacgggtgagtaacacgtaggcaacctgcctgtaagatcgggataactaccggaaacggtagctaagaccggataatcggtatctccgcatggggagatcgtgaaacacggagcaatctgtggcttacggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgccaaggagagtaactgctctttgggtgacggtacctgagaagaaagccccggctaactacgtgccagcagccgcggtaatacgtagggggcaagcgttgtccggaattattgggcgtaaagcgcgcgcaggcggttttttaagtctggtgtttaatcccgaggctcaacctcggttcgcaccggaaactgggagactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacaggattagataccctggtagtccacgccgtaaacgatgcatgctaggtgttaggggtttcgatacccttggtgccgaagttaacacagtaagcatgccgcctggggagtacgctcgcaagagtgaaactcaaaggaattgacggggacccgcacaagcagtggagtatgtggtttaattcgaagcaacgcgaagaaccttaccaggtcttgacatccctctgaccggcttagagataagcctttccttcgggacagaggtgacaggtggtgcatggttgtcgtcagctcgtgtcgtgagatgttgggttaagtcccgcaacgagcgcaacccttgaacttagttgccagcaggttaagctgggcactctaagttgactgccggtgacaaaccggaggaaggcggggatgacgtcaaatcatcatgccccttatgacctgggctacacacgtactacaatggccggtacaacgggaagcgaaggagcgatctggagccaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttct

SEQ ID NO: 1404 - DNA, 1434 bp, Paenibacillus sp.
  JC66
atcctggctcaggacgaacgctggcggcgtgcstaatacatgcaagtcgagcggagcatatcgcgatcttcggatggcaatacgcttagcggcgaacgggtgagtaacacgtaggcaacctgcctgtaagatcgggataacttgcggaaacgtgagctaataccggatgtgcttgagtccacgcctgtgggtttaaggaaagacggagcaatctgtcacttacagatgggcctgcggcgcattagctagttggtgaggtaacggctcaccaaggcgacgatgcgtagccgacctgagagggtgaccggccacactgggactgagacacggcccagactcctacgggaggcagcagtagggaatcttcggcaatggacggaagtctgaccgagcaacgccgcgtgagtgaagaaggttttcggatcgtaaaactctgttgccagagaagaacgccaaggagagtaactgctctttgggtgacggtatctgagaagaaagccccggctaactacgtgccagcagccgcggtaatacgtagggggcaagcgttgtccggaattattgggcgtaaagcgcgcgcaggcggtgaattaagtctgatgtttaaacccggggctcaacctcgggtcgcattggaaactggttgactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacaggattagataccctggtagtccacgccgtaaacgatgaatgctaggtgtcaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctttgaccggtgcagagatgtgcctttccttcgggacagaggagacaggtggtgcatggttgtcgtcagctcgtgtcgtgagatgttgggttaagtcccgcaacgagcgcaacccttgatgctagttgccagcattcagttgggcactctaggatgactgccggtgacaaaccggaggaaggtggggatgacgtcaaatcatcatgccccttatgacctgggctacacacgtactacaatggccggtacaacgggcagcgaaggagcgatctggagcgaatcccaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtc

SEQ ID NO: 1405 - DNA, 1522 bp, Paenibacillus sp.
  R-27413
gacgaacgctggcggcgtgcctaatacatgcaagtcgagcggagcttagccttcctttggaaggctytggcttagcggcggacgggtgagtaacacgtaggcaacctgcccgtaagaccgggataacttgcggaaacgtgagctaataccggatagataggaagagcgcatgctyttcttaggaaagacggagcaatctgtcacttacggatgggcctgcggcgcattagctagttggtggggtaaaggcctaccaaggcgacgatgcgtagccgacctgagagggtgaccggccacactgggactgagacacggcccagactcctacgggaggcagcagtagggaatcttcggcaatggacggaagtctgaccgagcaacgccgcgtgagtgaagaaggttttcggatcgtaaaactctgttgccagagaagaaagctaaggagagtcactgctctttggttgacggtatctgagaagaaagccccggctaactacgtgccagcagccgcggtaatacgtagggggcaagcgttgtccggaattattgggcgtaaagcgcgcgcaggcggctgagtaagtctggtgtttaaacctggggctcaacctcgggtcgcattggaaactgcttggctggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacaggattagataccctggtagtccacgccgtaaacgatgaatgctaggtgtcaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgtyctagagatagggcttcccttcggggcagaggagacaggtggtgcatggttgtcgtcagctcgtgtcgtgagatgttgggttaagtcccgcaacgagcgcaacccttgatcttagttgccagcattgagttgggcactctaggatgactgccggtgacaaaccggaggaaggtggggatgacgtcaaatcatcatgccccttatgacctgggctacacacgtactacaatggccggtacaacgggcagcgaaggagcgatccggagcgaatcccaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgaaagtttacaacacctgaagtcggtgaggtaaccgcaaggagccagccgccgaaggtggggtagatgattggggtgaagtcgtaacaaggtagccgtatcggaaggtgcggctggatcacctcct

SEQ ID NO: 1406 - DNA, 1004 bp, Paenibacillus sp.
  R-27422
  modified_base (31)..(33): a, c, t, g, unknown or other
  modified_base (54)..(54): a, c, t, g, unknown or other
agagagagtaactgctctttgggtgacggtnnngagaagaaagccccggctaantacgtgccagcagccgcggtaatacgtagggggcaagcgttgtccggaattattgggcgtaaagcgcgcgcaggcggttctttaagtctggtgtttaaacccggagcttaacttcgggacgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctttgacccctctagagatagaggtttccttcgggacagaggagacaggtggtgcatggttgtcgtcagctcgtgtcgtgagatgttgggttaagtcccgcaacgagcgcaacccttgatcttagttgccagcacgtaatggtgggcactctaaggtgactgccggtgacaaaccggaggaaggtggggatgacgtcaaatcatcatgccccttatgacctgggctacacacgtactacaatggctggtacaacgggaagcgaagccgcgaggtggagccaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggagcca

SEQ ID NO: 1407 - DNA, 1515 bp, Paenibacillus sp.
  oral taxon F45
agagtttgatcctggctcaggacgaacgctggcggcatgcctaatacatgcaagtcgagcggagttgacgagaagcttgcttctctgatgcttagcggcggacgggtgagtaacacgtaggcaacctgcctttcagactgggataacttccggaaacggatgctaataccggatacatcgtttcttcgcatgaagagacgaggaaagacggcgcaagctgtcactgagagatggacctgcggcgcattagctagttggtggggtaatggcccaccaaggcgacgatgcgtagccgacctgagagggtgaacggccacactgggactgagacacggcccagactcctacgggaggcagcagtagggaatcttccacaatgggcgaaagcctgatggagcaatgccgcgtgagtgatgaaggttttcggatcgtaaagctctgttgccagggaagaacgtttcgtagagtaactgctgcggaagtgacggtacctgagaagaaagccccggctaactacgtgccagcagccgcggtaatacgtagggggcaagcgttgtccggaattattgggcgtaaagcgcgtgcaggcggcttcttaagttgggtgtttaagaccggggctcaaccccggctcgcacccaaaactgggaagcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgagtgctaggtgttcggggtttcgataccctgggtgccgaagttcacgcattaagcactccgcctggggagtacggccgcaaggctgaaactcaaaggaattgacggggacccgcacaagcagtggagtatgtggtttaattcgaagcaacgcgaagaaccttaccaggtcttgacatccctctgaccggtctagagatagaccttcccttcggggtagaggagacaggtggtgcatggttgtcgtcagctcgtgtcgtgagatgttgggttaagtcccgcaacgagcgcaacccttgactttagttgccagcatttcggatgggcactctagagtgattgccggtgacaaaccggaggaaggcggggatgacgtcaaatcatcatgccccttatgacctgggctacacacgtactacaatggccggtacagagggtcgcgaagccgcgaggtggagccaatcccagaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgt

SEQ ID NO: 1408 - DNA, 1541 bp, Paenibacillus timonensis
gacgaacgctggcggcgtacctaatacatgcaagtcgagcggagttaatcgggagcttgctcctgattagcttagcggcggacgggtgagtaacacgtaggcaacctgcccgtaagactgggataactaccggaaacggtagctaataccggatacgcaaattcctcgcatgggggatttgggaaaggcggagcaatctgtcacttacggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtcctctagagtaactgctaggggagtgacggtacctgagaagaaagccccggctaactacgtgccagcagccgcggtaatacgtagggggcgagcgttgtccggaattattgggcgtaaagcgcgcgcaggcggctgtttaagtctggtgtttaatcctggggctcaactccgggtcgcactggaaactgggcagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggccgcaaggctgaaactcaaaggaattgacggggacccgcacaagcagtggagtatgtggtttaattcgaagcaacgcgaagaaccttaccaggtcttgacatccccctgaccggtctagagataggcctttccttcgggacaggggagacaggtggtgcatggttgtcgtcagctcgtgtcgtgagatgttgggttaagtcccgcaacgagcgcaacccttgactttagttgccagcaggtaaggttgggcactctagagtgactgccggtgacaaaccggaggaaggtggggatgacgtcaaatcatcatgccccttatggcctgggctacacacgtactacaatggccggtacaacgggaagcgaagccgcgaggtggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaacctgagctaccccaaaaagtgaagattatgctgcgaagcgtattccgagtacttttcggggaccccggtttggagccagccgccgaaggtggggtagatgattggggtg

SEQ ID NO: 1409 - DNA, 1504 bp, Pantoea agglomerans
agagtttgatccctggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgtacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggtttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgta

SEQ ID NO: 1410 - DNA, 1542 bp, Pantoea ananatis
taaattgaagagtttgatcatggctcagattgaacgctggcggcaggcctaacacatgcaagtcggacggtagcacagaggagcttgctcctctggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcattgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 1411 - DNA, 1344 bp, Pantoea brenneri
ggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgyggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctygtagaggggggtagaattccaggtgtagcggtgaaatgcgtagagatctggaggaataccggtggcgaaggcggccccctggacraagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacct

SEQ ID NO: 1412 - DNA, 1422 bp, Pantoea citrea
attgaacgctggcggcaggcctaacacatgcaagtcgaacggtagcacagaggagcttgctccttgggtgacgagtggcggacgggtgagtaatgtctgggaaactgcctgatggrgggggataactactggaaacggtagctaataccgcataacgtcgcaagaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtcaggaggaagggtgtagtcttaaacggctatgcattgacgttactgacagaagaagcaccggctaactccgtgccagcagccgcggtaatacggagggtgcaagcgttaatcggaattactgggcgtaaagcgcacgcaggcggtctgtcaagtcggatgtgaaatccccgggctcaacccgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggygtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccctatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtagatagcttaacct

SEQ ID NO: 1413 - DNA, 1344 bp, Pantoea conspicua
ggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttggcagagatgccttggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacct

SEQ ID NO: 1414 - DNA, 1344 bp, Pantoea septica
ggacgggtgagtaatgtctgggaaactgcccgatggagggggataactactggaaacggtagctaataccgcataacgtcgcragaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgyggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgtttccttgagaagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttgscagagatgscctggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacct

SEQ ID NO: 1415 - DNA, 1491 bp, Papillibacter cinnamivorans
  modified_base (449)..(449): a, c, t, g, unknown or other
  modified_base (454)..(454): a, c, t, g, unknown or other
  modified_base (589)..(589): a, c, t, g, unknown or other
  modified_base (1427)..(1427): a, c, t, g, unknown or other
gatcctggctcaggacgaacgctggcggcgtgcctaacacatgcaagtcgaacgaaaataccaaagcagcaatgcgggggtattttagtggcggacgggtgagtaacgcgtgagcaatctgccttttggagggggataccgactggaaacggtcgttaataccgcataacgtatatggacgacatcgtccgtataccaaaggagcaatccgccgaaagatgagctcgcgtctgattagctagttggcggggtaaaggcccaccaaggcgacgatcagtagccggactgagaggttgaacggccacattgggactgagatacggcccagactcctacgggaggcagcagtggggaatattgggcaatgggcgaaagcctgacccagcaacgccgcgtcaaggaagaaggccttcgggttgtaaacttcttttaccagggaagaagaagtncggtncctggaaaacaagccacggctatctacgtgccagcagccgcggtaatacgtaggtggcaagcgttgtccggatttactgggtgtaaagggcgcgtaggcggcattgcaagtcagatgtgaaatgccggggcttanccccggagctgcatttgaaactgtagagcttgagtgatggagaggcaggcggaattcctagtgtagcggtgaaatgcgtagatattaggaggaacaccagtggcgaaggcggcctgctggacattaactgacgctgaggcgcgaaagcgtggggagcaaacaggattagataccctggtagtccacgctgtaaacgatggatactaggtgtgggaggtctgaccccttccgtgccggagttaacacaataagtatcccacctggggagtacgatcgcaaggttgaaactcaaaggaattgacgggggcccgcacaagcagtggagtatgtggtttaattcgaagcaacgcgaagaaccttaccaggatttgacatcctactaacgaggtagagatacgtcaggtgcccttcggggaaagtagagacaggtggtgcatggttgtcgtcagctcgtgtcgtgagatgttgggttaagtcccgcaacgagcgcaacccttattgctagttgctacgcaagagcactctagcgagactgccgttgacaaaacggaggaaggcggggacgacgtcaaatcatcatgccccttatgtcctgggctacacacgtactacaatggcggttaacagagggaagcaagacagtgatgtggagcaaatccctaaaaaccgtctcagttcggatcgcaggctgcaacccgcctgcgtgaagtcggaattgctagtaatcgcggatcagcatgccgcggtgaatacgttcccgggccttgtacacaccgcccgtcacaccatgagagtcgggaatacccgaagtccgtagtctaaccgcaagggggacgcngccgaaggtaggttcgataattggggtgaagtcgtaacaaggtaaccgtatcggaaggtgcggc

SEQ ID NO: 1416 - DNA, 1349 bp, Parabacteroides distasonis
accgggtggcgaccggcgcacgggtgagtaacgcgtatgcaacttgcctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactgggaggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacacagtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcagttcccgttggaaatgggagttttgagtatgttcgagtcaggcggaatgcgtggtttagcggtgaaatgctcaggaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggaagccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaa

SEQ ID NO: 1417 - DNA, 1383 bp, Parabacteroides goldsteinii
aggggcagcacgatgtagcaatacattggtggcgaccggcgcacgggtgagtaacgcgtatgcaacctacctatcagaggggaataacccggcgaaagtcggactaataccgcataaaacaggggttccacatggaaatatttgttaaagaattatcgctgatagatgggcatgcgttccattagatagttggtgaggtaacggctcaccaagtccacgatggataggggttctgagaggaaggtcccccacactggtactgagacacggaccagactcctacgggaggcagcagtgaggaatattggtcaatgggcgagagcctgaaccagccaagtcgcgtgaaggatgaaggatctatggtttgtaaacttcttttatatgggaataaagtgaggaacgtgttcctttttgtatgtaccatatgaataagcatcggctaactccgtgccagcagccgcggtaatacggaggatgcgagcgttatccggatttattgggtttaaagggtgcgtaggtggttaattaagtcagcggtgaaagtttgtggctcaaccataaaattgccgttgaaactggttgacttgagtatatttgaggtaggcggaatgcgtggtgtagcggtgaaatgcatagatatcacgcagaactccgattgcgaaggcagcttactaaactataactgacactgaagcacgaaagcgtggggatcaaacaggattagataccctggtagtccacgcagtaaacgatgattactagctgtttgcgatacacagtaagcggcacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgcattcggaccggagtggaaacacttcttctagcaatagccgtttgcgaggtgctgcatggttgtcgtcagctcgtgccgtgaggtgtcggcttaagtgccataacgagcgcaacccttatcactagttactaacaggtcatgctgaggactctagtgagactgccagcgtaagctgtgaggaaggtggggatgacgtcaaatcagcacggcccttacatccggggcgacacacgtgttacaatggtggggacaaagggcagctaccgggcgacaggatgctaatctccaaaccccatctcagttcggatcgaagtctgcaacccgacttcgtgaagctggattcgctagtaatcgcgcatcagccatggcgcggtgaatacgttcccgggccttgtacacaccgcccgtcaagccatgggagttgggggtacctaaagtccgtaaccgcaaggatc

SEQ ID NO: 1418 - DNA, 1326 bp, Parabacteroides gordonii
gagtttgatcctggctcaggatgaacgctagcgacaggcttaacacatgcaagtcgagggaccggcgcacgggtgagtaacgcgtatgcaacctacctatcagagggggataacccggcgaaagtcggactaataccgcataaataaagttgctgatagatgggcatgcgttccattagatagttggtaaggtaacggcttaccaagtctgcgatggataggggttctgagaggaaggtcccccacactggtactgagacacggaccagactcctacgggaggcagcagtgaggaatattggtcaatgggcgagagcctgaaccagccaagtcgcgtgaaggatgaaggattatggttcgtaaacttcttttataagggaatatgtatgtaccttatgaataaggatcggctaactccgtgccagcagccgcggtaatacggaggatccgagcgttatccggatttattgggtttaaagggtgcgtaggtggtttattaagtcagcggtgaaagtttgtggctcaaccataaaattgccgttgaaactggttaacttgagtatatttgaggtaggcggaatgcgtggtgtagcggtgaaatgcatagatatcacgcagaactccaattgcgaaggcagcttactaaactaactgacactgaagcacgaaagcgtggggatcaaacaggattagataccctggtagtccacgcagtaaacgatgattactaggagtttgcgagtaagctctacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgcgcgaggtgctgcatggttgtcgtcagctcgtgccgtgaggtgtcggcttaagtgccataacgagcgcaacccttatctttagttactaacagctgaggactctaaagagactgccagcgtaagctggaggaaggtggggatgacgtcaaatcagcacggcccttacatccggggcgacacacgtgttacaatggtgggcaaagggcagctacacagcgatgtgatgctaatctcccccatctcagttcggacgaagtctgcaacccgacttcggaagctggattcgctagtaatcgcgcatcagccatggcgcggtgaatacgttcccgggccttgtacacaccgcccgtcaagccatgggagttgggggtacctaaagtccgtatcggcctagggtaaaaccgatgactggggctaagtcgtaacaaggtaacc

SEQ ID NO: 1419 - DNA, 1344 bp, Parabacteroides johnsonii
gaccggcgcacggtggagtaacgcgtatgctacttacctatcagagggggatagcccggcgaaaggcggattaatactccataaaacaggggttccgcatgggactatttgttaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgaaggatgaaggatctatggtttgtaaacttcttttataggggaataaagtgtgggacgtgtcccattttgtatgtaccctatgaataagcatcggctaactccgtgccagcagccgcggtaatacggaggtgcgagcgttatccggatttattgggtttaaagggtgcgtaggtggtaatttaagtcagcggtgaaagtttgtggctcaaccataaaattgccgttgaaactgggttacttgagtgtgtttgaggtaggcggaatgcgtggtgtagcggtgaaatgcatagatatcacgcagaactccaattgcgaaggcagcttactaaaccataactgacactgaagcacgaaagcgtgggtatcaaacaggattagataccctggtagtccacgcagtaaacgatgattactaggagtttgcgatacacagtaagctctacagcgaaagcgttaagtaatccacctggggagtacgccggcaacggtgaaactcaaaggaattgacgggggcccgcacaagcggagaacatgtggtttaattcgatgatacgcgaggaaccttacccgggtttgaacgtagtcagaccggccttgaaagaggtcttctagcaatagctgattacgaggtgctgcatggttgtcgtcagctcgtgccgtgaggtgtcggcttaagtgccataacgagcgcaacccttatcactagttactaacaggttaagctgaggactctggtgagactgccagcgtaagctgtgaggaaggtggggatgacgtcaaatcagcacggcccttacatccggggcgacacacgtgttacaatggcatggacaaagggcagctacctggcgacaggatgctaatctctaaaccatgtctcagttcggatcggagtctgcaactcgactccgtgaagctggattcgctagtaatcgcgcatcagccatggcgcggtgaatacgttcccgggccttgtacacaccgcccgtcaagccatgggagccgggggtacctgaagtccgtaaccgcaag

SEQ ID NO: 1420 - DNA, 1374 bp, Parabacteroides merdae
atgatttgtagcaatacagattgatggcgaccggcgcacgggtgagtaacgcgtatgcaacttacctatcagagggggatagcccggcgaaagtcggattaataccccataaaacaggggtcccgcatgggaatatttgttaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgaaggaagaaggatctatggtttgtaaacttcttttataggggaataaagtggaggacgtgtccttttttgtatgtaccctatgaataagcatcggctaactccgtgccagcagccgcggtaatacggaggatgcgagcgttatccggatttattgggtttaaagggtgcgtaggtggtgatttaagtcagcggtgaaagtttgtggctcaaccataaaattgccgttgaaactgggttacttgagtgtgtttgaggtaggcggaatgcgtggtgtagcggtgaaatgcatagatatcacgcagaactccgattgcgaaggcagcttactaaaccataactgacactgaagcacgaaagcgtggggatcaaacaggattagataccctggtagtccacgcagtaaacgatgattactaggagtttgcgatacaatgtaagctctacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgtagtctgaccggctcaaccataaaacttccagcaatagcagattacgaggtgctgcatggttgtcgtcagctcgtgccgtgaggtgtcggcttaagtgccataacgagcgcaacccttatcactagttactaacaggtgaagctgaggactctggtgagactgccagcgtaagctgtgaggaaggtggggatgacgtcaaatcagcacggcccttacatccggggcgacacacgtgttacaatggcatggacaaagggcagctacctggcgacaggatgctaatctccaaaccatgtctcagttcggatcggagtctgcaactcgactccgtgaagctggattcgctagtaatcgcgcatcagccatggcgcggtgaatacgttcccgggccttgtacacaccgcccgtcaagccatgggagccgggggtacctgaagtccgtaaccgcaag

SEQ ID NO: 1421 - DNA, 973 bp, Parabacteroides sp.
  D13
  modified_base (9)..(12): a, c, t, g, unknown or other
  modified_base (17)..(17): a, c, t, g, unknown or other
  modified_base (21)..(21): a, c, t, g, unknown or other
ttgtatgtnnnnatgantaangatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcatagatatcacgcagaaccccgattgcgaaggcagcctgccaagccattactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgaaaggatcgg

SEQ ID NO: 1422 - DNA, 1481 bp, Parabacteroides sp.
  NS31-3
agagtttgatcctggctcaggatgaacgctagcgacaggcttaacacatgcaagtcgaggggcagcatagaagtagcaatactttggtggcgaccggcgcacgggtgagtaacgcgtatgcaacctacctatcagaggggaataacccggcgaaagtcggactaataccgcataaaacaggggcaccgcatggtgatatttgttaaagaaattcgctgatagatgggcatgcgttccattaggtagttggtgaggtaacggctcaccaagccgacgatggataggggaactgagaggttggtcccccacactggtactgagacacggaccagactcctacgggaggcagcagtgaggaatattggtcaatgggcgggagcctgaaccagccaagtcgcgtgaaggaagaaggatctatggttcgtaaacttcttttgcaggggaataaagtgcgggacgtgtcctgttttgtatgtaccctgagaataaggatcggctaactccgtgccagcagccgcggtaatacggaggatccgagcgttatccggatttattgggtttaaagggtgcgtaggtggtttgataagtcagcggtgaaagtttgcagcttaactgtaaaaatgccgttgaaactgtcggacttgagtgtaaatgaggtaggcggaatgcgtggtgtagcggtgaaatgcatagatatcacgcagaactccgattgcgaaggcagcttactaagctacaactgacactgaagcacgaaagcgtggggatcaaacaggattagataccctggtagtccacgcagtaaacgatgattactagctgtttgcgatacacagtaagcggcacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgtagggagacaggggtggaaacatccttttcagcaatgactgcctacgaggtgctgcatggttgtcgtcagctcgtgccgtgaggtgtcggcttaagtgccataacgagcgcaacccttatttccagttactaacaggtgatgctgaggactctggagagactgccagcgtaagctgtgaggaaggtggggatgacgtcaaatcagcacggcccttacatccggggcgacacacgtgttacaatggtaaggacaaagggcagctaccgggcgaccggatgcgaatctctaaaccttatctcagttcggatcggagtctgcaactcgactccgtgaagctggattcgctagtaatcgcgcatcagccatggcgcggtgaatacgttcccgggccttgtacacaccgcccgtcaagccatgggagccgggggtacctgaagttcgtaaccgtaaggatcgacctagggtaaaactggtgactggggctaagtcgtaacaa

SEQ ID NO: 1423 - DNA, 1537 bp, Parachlamydia sp.
  UWE25
tgagaatttgatcttggttcagattgaatgctgacagcgtggatgaggcatgcaagtcgaacgaaaccttcgggtttagtggcggaagggttagtaagacatggataacttgcctttaactctgggataacggttggaaacgaccgctaataccggatagggtgaaaagaagacatcttttttttattaaagtgggggatcgcaagacctcgcggttaaagagaggtccatgggatatcagctagttggtgtggtaaaggcgcaccaaggctaagacgtctaggcggattgagagattgaccgccaacactgggactgagaactgcccagactcctacgggaggctgcagtcgagaatcattcgcaatgggcgaaagcctgacgatgcgacgctgtgtgagtgaagaaggccttagggtcgtaaagctctttcgcctgggaacaagatgagctggctaacatccagtgattttgagcgtaccaggtaaagaagcaccggctaactccgtgccagcagctgcggtaatacggagggtgcaagcattaatcggatttattgggcgtaaagggcgcgtaggcgggggtgtcagtcagatgtgaaatcccgaggctcaacctcggaacagcatttgaaactacatctctagagggtaggcggagaaaacggaattccacaagtagcggtgaaatgcgtagatatgtggaagaacaccggtggcgaaggcggttttctagcttatacctgacgctaaagcgcgaaagcaaggggatcaaacaggattagataccctggtagtccttgccgtaaactatgtatacttggtgtaactggactcaaccctagttgtgccgtagctaacgcgttaagtataccgcctggggagtacagtcgcaaggctgaaactcaaaagaattgacggggacccgcacaagcagtggagcatgtggtttaattcgatgcaacgcgaagaaccttacccagacttgacatgtagtagaccggtctagaaataggcctttccttcgggactgctacacaggtgctgcatggctgtcgtcagctcgtgccgtgaggtgttgggttaagtcccgcaacgagcgcaacccttatcattagttgccaacatttaaggtgggaactctaatgagactgcctgggttaaccaggaggaaggtgaggatgacgtcaagtccgcatggcccttatgtctggggctacacacgtgctacaatggtcggtacaaaaggcagcgaagccgcgaggtgaagcaaatcccgaaagccggccccagttcagattgtagtctgcaactcgactacatgaagacggaattgctagtaatggcgagtcagcaacatcgccgtgaatacgttcccgggtcttgtacacaccgcccgtcacatcatgggagttggttttacccgaatccgctggcttaaccgcaagggaagaggcgtgtaaggtgaggccgatgactgggatgaagtcgtaacaaggtagccctaccggaaggtggggctggatcacctcctttaa

SEQ ID NO: 1424 - DNA, 1463 bp, Paracoccus denitrificans
caacttgagagtttgatcctggctcagaacgaacgctggcggcaggcctaacacatgcaagtcgagcgaacccttcggggttagcggcggacgggtgagtaacgcgtgggaatatgccctttgctacggaatagccccgggaaactgggagtaataccgtatacgccctttgggggaaagatttatcggcaaaggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccggaaagttgggggtgaaatcccggggctcaacctcggaactgccttcaaaactatcggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgcaggaccgctccagagatggagttttctcgtaagagacctgtggacaggtgctgcatggctgtcgtcagctcgtgtcgtgagatgttcggttaagtccggcaacgagcgcaacccacactcttagttgccagcatttggttgggcactctaagagaactgccgatgataagtcggaggaaggtgtggatgaagtcaagtcctcatggcccttacgggttgggctacacacgtgctacaatggtggtgacagtgggttaatccccaaaagccatctcagttcggattggggtctgcaactcgaccccatgaagttggaatcgctagtaatcgcggaacagcatgccgcggtgaatacgttcccgggccttgtacacaccgcccgtcacaccatgggagttgggtctacccgacggccgtgcgctaaccagcaatggaggcagcggaccacggtaggctcagcgactggggtgaagtcgtaacaaggtagccgtaggggaacctgcggctggatcacctccttt

SEQ ID NO: 1425 - DNA, 1430 bp, Paracoccus marcusii
cagaacgaacgctggcggcaggcttaacacatgcaagtcgagcgagaccttcgggtctagcggcggacgggtgagtaacgcgtgggaacgtgcccttctctacggaatagccccgggaaactgggagtaataccgtatacgccctttgggggaaagatttatcggagaaggatcggcccgcgttggattaggtagttggtggggtaatggcccaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggactggaaagtcagaggtgaaatcccagggctcaaccttggaactgcctttgaaactatcagtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggcaagcatgcttgtcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggcaggaccgctggagagattcagctttctcgtaagagacctgcacacaggtgctgcatggctgtcgtcagctcgtgtcgtgagatgttcggttaagtccggcaacgagcgcaacccacgtccctagttgccagcattcagttgggcactctatggaaactgccgatgataagtcggaggaaggtgtggatgacgtcaagtcctcatggcccttacgggttgggctacacacgtgctacaatggtggtgacagtgggttaatccccaaaagccatctcagttcggattgtcctctgcaactcgagggcatgaagttggaatcgctagtaatcgcggaacagcatgccgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcac

SEQ ID NO: 1426 - DNA, 1500 bp, Paraprevotella clara
agagtttgatcctggctcaggatgaacgctagcggcaggcctaacacatgcaagtcgagggaggagctttcgggcttcgaccggcgtacgggtgcgtaacgcgtatacaatctgcctttcacatagggatagcccgaagaaatttggattaatacctaatggtatatagggatggcatcatttttatattaaagctgaggcggtgaaagatgagtatgcgttctattagctagttggagaggtaacggctccccaaggctacgatagataggggttctgagagggatatcccccacactggtactgagatacggaccagactcctacgggaggcagcagtgaggaatattggacaatggtcggaagactgatccagccatgccgcgtgcaggaagacggccttatgggttgtaaactgcttttgcaggggaagaataaggagtacgtgtactttgatgacggtactctgcgaataagcatcggctaactccgtgccagcagccgcggtaatacggaggatgcgagcgttatccggaatcattgggtttaaagggtccgtaggcgggctaataagtcagaggtgaaagcgctcagctcaactgagcaactgcctttgaaactgttagtcttgaatggttgtgaagtagttggaatgtgtagtgtagcggtgaaatgcttagatattacacagaacaccgatagcgaaggcatattactaacaattaattgacgctgatggacgaaagcgtggggagcgaacaggattagataccctggtagtccacgctgtaaacgatggatactagctgtttggttgtaagactgagtggctaagcgaaagtgataagtatcccacctggggagtacgcacgcaagtgtgaaactcaaaggaattgacgggggcccgcacaagcggaggaacatgtggtttaattcgatgatacgcgaggaaccttaccaaggtttaaatggagactgacaggtgtagagatacgcttttcttcggacagttttcaaggtgctgcatggttgtcgtcagctcgtgccgtgaggtgtcaggttaagtcctataacgagcgcaacccctgccattagttgctagcgagtcgagtcgagcactctagtgggactgccggtgcaaaccgtgaggaaggtggggatgacgtcaaatcatcacggcccttacatcttgggctacacacgtgctacaatggtcgttacagagagcagccactgcgtgagcaggcgcgaatctataaagacgatcacagttcggatcggagtctgcaactcgactccgtgaagctggaatcgctagtaatcggatatcagccatgatccggtgaatacgttcccgggccttgtacacaccgcccgtcaagccatggaagctgggggtacctgaagacggtcaccgaaaggagctgtttagggtaaaactagtgactggggctaagtcgtaacaaggtagccgtaccggaaggtgcggctggaacacct

SEQ ID NO: 1427 - DNA, 1532 bp, Paraprevotella xylaniphila
tacaatggagagtttgatcctggctcaggatgaacgctagctacaggcttaacacatgcaagtcgaggggcagcatgaacttagcttgctaagtttgatggcgaccggcgcacgggtgagtaacgcgtatccaacctgccctttacgcggggatagccttctgaaaggaagtttaatacccgatgaattcgtttagtcgcatggcttgatgaataaagatttatcagtaaaggatggggatgcgtcccattagcttgttggcggggtaacggcccaccaaggcgacgatgggtaggggttctgagaggaaggtcccccacattggaactgagacacggtccaaactcctacgggaggcagcagtgaggaatattggtcaatgggcgcgagcctgaaccagccaagtagcgtggaggacgacggccctacgggttgtaaactccttttataaggggataaagttggccatgtatggccatttgcaggtaccttatgaataagcatcggctaattccgtgccagcagccgcggtaatacggaagatgcgagcgttatccggatttattgggtttaaagggagcgtaggcgggcagtcaagtcagcggtcaaatggcgcggctcaaccgcgttccgccgttgaaactggcagccttgagtatgcacagggtacatggaattcgtggtgtagcggtgaaatgcttagatatcacgaggaactccgatcgcgcaggcattgtaccggggcattactgacgctgaggctcgaaggtgcgggtatcaaacaggattagataccctggtagtccgcacagtaaacgatgaatgcccgctgtcggcgacatagtgtcggcggccaagcgaaagcgttaagcattccacctggggagtacgccggcaacggtgaaactcaaaggaattgacgggggcccgcacaagcggaggaacatgtggtttaattcgatgatacgcgaggaaccttacccgggcttgaatcgcaggtgcatgggccggagacggccctttccttcgggactcctgcgaaggtgctgcatggttgtcgtcagctcgtgccgtgaggtgtcggcttaagtgccataacgagcgcaacccccctccccagttgccatcgggtaatgccgggcactttggggacactgccaccgcaaggtgcgaggaaggtggggatgacgtcaaatcagcacggcccttacgtccggggcgacacacgtgttacaatggggggtacagagggccgctgcccggtgacggttggccaatccctaaagcccctctcagttcggactggagtctgcaacccgactccacgaagctggattcgctagtaatcgcgcatcagccatggcgcggtgaatacgttcccgggccttgtacacaccgcccgtcaagccatgaaagccgggggtgcctgaagtccgtgaccgcgagggtcggcctagggtaaaaccggtgattggggctaagtcgtaacaaggtagccgtaccggaaggtgcggctggaacacctcctttct

SEQ ID NO: 1428 - DNA, 1532 bp, Parascardovia denticolens
tttttgtggagggttcgattctggctcaggacgaacgctggcggcgtgcttaacacatgcaagtcgaacgggatcctctccagcttgctgggggggtgagagtggcgaacgggtgagtaatgcgtgactaacctgcctcatggtctggaatagctcctggaaacgggtggtaatgccggatggtccaactttccgcatggtttgttgggaaagcttttgcgccatgggatggggtcgcgtcctatcagcttgttggtggggtgttggcctaccaaggcttcgacgggtagccggcctaagagggcgaccggccacattgggactgagatacggcccagactcctacgggaggcagcagtggggaatattgcacaatggggggaaccctgatgcagcgacgccgcgtgcgggatggaggccttcgggtcgtgaaccgcttttacaggggagcaagctttcgggtgagttaactttgtgaataagcaccggctaactacgtgccagcagccgcggtaatacgtagggtgcaagcgttgtccggatttattgggcgtaaagggctcgtaggcggttcgtcgcgtctggtgtgaaagcccgctgcttaacggtgggtttgcgttggatacgggcgggcttgagtgcagtaggggagactggaattctcggtgtaacggtggaatgtgtagatatcgggaagaacacctatggcgaaggcaggtctctgggctgttactgacgctgaggagcgaaagcgtggggagcgaacaggattagataccctggtagtccacgctgtaaacggtggacgctggatgtggggcccatttccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttaccagggcttgacatgttgacgatcgcctcagagatggggcttcccttcggggcgtcttcacaggtggtgcatggtcgtcgtcagctcgtgtcgtgagatgttgggttaagtcccgcaacgagcgcaaccctcgctttgtgttgccagcgggtcgtgccgggtactcgcaagggaccgccggggttaactcggaggaaggtggggatgacgtcagatcatcatgccccttacgtcctgggcttcacgcatgctacaatggccggtacagcgggatgcgatgccgtgaggcggagcggatcctgtaaaaccggtctcagttcggatcggagcctgcaactcggctccgtgaaggtggagtcgctagtaatcgcggatcagcaacgccgcggtgaatgcgttcccgggccttgtacacaccgcccgtcaagtcatgaaagtgggcagcacccgaagccggtggcctaacccttgtggggggagccgtctaaggtgaggtccgcgattgggactaagtcgtaacaaggtagccgtaccggaaggtgcggctggatcacctcctttct

SEQ ID NO: 1429 - DNA, 1026 bp, Parasutterella excrementihominis
  modified_base (864)..(864): a, c, t, g, unknown or other
  modified_base (935)..(935): a, c, t, g, unknown or other
  modified_base (969)..(970): a, c, t, g, unknown or other
  modified_base (980)..(980): a, c, t, g, unknown or other
  modified_base (982)..(982): a, c, t, g, unknown or other
  modified_base (1011)..(1011): a, c, t, g, unknown or other
acgcggagagaagcttgcttctctccggcgacgagtggcgaacgggtgagtaatacatcggaacgtgtccgctcgtgggggacaaccagccgaaaggttggctaataccgcatgagttctacggaagaaagagggggacccgcaagggcctctcgcgagcggagcggccgatgactgattagccggttggtgaggtaacggctcaccaaagcaacgatcagtagctggtctgagaggacgaccagccacactgggactgagacacggcccagactcctacgggaggcagcagtggggaattttggacaatgggcgcaagcctgatccagctattccgcgtgtgggatgaaggccctcgggttgtaaaccacttttgtagagaacgaaaagacaccttctaataaagggtgttgctgacggtactctaagaataagcaccggctaactacgtgccagcagccgcggtaatacgtagggtgcgagcgttaatcggaattactgggcgtaaagggtgcgcaggcggttgagtaagacagatgtgaaatccccgagcttaactcgggaatggcatatgtgactgctcgactagagtgtgtcagagggaggtggaattccacgtgtagcagtgaaatgcgtagatatgtggaagaacaccgatggcgaaggcagcctcctgggacataactgacgctcaggcacgaaagcgtggggagcaaacaggattagataccctggtagtccacgccctaaacgatgttaactagttgttgggaagtaaaattctcagtaacgcagccaacgcgagaagttaaccgcctgggaagtacggtcgcaagactaaaactcaaaggaattgacgggganccgcacaagcggtggatgatgtggattaattcgatgcaacgcgaaaaaccttacctacccttgacatgtcnggaagctcttgtaatgagagtgtgcccgcaaggnncctgaacacngntgctgcatggctgtcgtcagctcgtgtcntgagatgttgggtta

SEQ ID NO: 1430 - DNA, 1320 bp, Parasutterella secunda
attgaacgctggcggcatgctttacacatgcaagtcgaacgagtggcgaacgggtgagtaatacatcggaacgtgtcctgttgtgggggataactactcgaaagagtagctaataccgcataaggaaaggcgcagttggagcggccgatgactgattagctagttggtggggtaaaggcctaccaaggcgacgatcagtagctggtctgagaggacgaccagccacattgggactgagacacggcccaaactcctacgggaggcagcagtggggaattttggacaatgggggcaaccctgatccagccatgccgcgtgcgggaagaaggccttcgggttgtaaaccgcttttgttaggaacgatgacggtacctaaagaataagcaccggctaactacgtgccagcagccgcggtaatacgtagggtgcgagcgttaatcggaattactgggcgtaaagcgtgcgcaggcggttgggtaagacaggtgtgaaatccccgagcttaacttgggaactgcacttgtgactgctcaactagagtatgtcagagggaggtggaattccaagtgtagcagtgaaatgcgtagatatttggaagaacaccgatggcgaaggcagcctcctgggataactgacgctcatgcacgaaagcgtggggagcaaacaggattagataccctggtagtccacgccctaaacgatgtcaactagttgttgggcgcttagtaacacagctaacgcgagaagttgaccgcctggggagtacggtcgcaagattaaaactcaaaggaattgacggggacccgcacaagcggtggatgatgtggattaattcgatgcaacgcgaaaaaccttacctagccttgacatgcacaggtgctgcatggctgtcgtcagctcgtgtcgtgagatgttgggttaagtcccgcaacgagcgcaacccttgtcactagttgctacagcactctagtgaaactgccggtgacaaaccggaggaaggtggggatgacgtcaagtcctcatggcccttatggctagggcctcacacgtcatacaatggtcggcagagggcagcgaagctgtgaagtggagccaatcccarccgatcgtagtccggatgcagtctgcaactcgactgcagaagtcggaatcgctagtaatcgcggatcagcatgccgcggtgaatacgttcccgggtcttgtacacaccgcccgtcacaccatgggagtggggttcaccagaaggcgttgcctagggcggcgaccacggtgggtttcatgactggggtgaagtcgtaacaaggtagcagtaccggaagg

SEQ ID NO: 1431 - DNA, 1487 bp, Parvimonas micra
agagtttgatcctggctcaggacgaacgctggcggcgtgcttaacacatgcaagtcgaacgtgatttttgtggaaattctttcgggaatggaaatgaaatgaaagtggcgaacgggtgagtaacacgtgagcaacctaccttacacagggggatagccgttggaaacgacgattaataccgcatgagaccacagaatcgcatgatataggggtcaaagatttatcggtgtaagaagggctcgcgtctgattagctagttggaagggtaaaggcctaccaaggcgacgatcagtagccggtctgagaggatgaacggccacattggaactgagacacggtccaaactcctacgggaggcagcagtggggaatattgcacaatggggggaaccctgatgcagcgacgccgcgtgagcgaagaaggttttcgaatcgtaaagctctgtcctatgagaagataatgacggtatcataggaggaagccccggctaaatacgtgccagcagccgcggtaatacgtatggggcgagcgttgtccggaattattgggcgtaaagggtacgtaggcggttttttaagtcaggtgtgaaagcgtgaggcttaacctcattaagcacttgaaactggaagacttgagtgaaggagaggaaagtggaattcctagtgtagcggtgaaatgcgtagatattaggaggaataccggtggcgaaggcgactttctggacttttactgacgctcaggtacgaaagcgtggggagcaaacaggattagataccctggtagtccacgccgtaaacgatgaatgctaggtgttgggagtcaaatctcggtgccgaagttaacacattaagcattccgcctggggagtacggtggcaacactgaaactcaaaggaattgacggggacccgcacaagcagcggagcatgtggtttaattcgaagcaacgcgaagaaccttaccaaggcttgacatatagttgagttattgagaaattgataagtccctcgggacaactatacaggtggtgcatggttgtcgtcagctcgtgtcgtgagatgttgggttaagtcccgcaacgagcgcaacccttatcttcagttgccagcacgtagaggtgggaactctggagagactgccgatgacaaatcggaggaaggtggggatgacgtcaaatcatcatgccctttatgtcttgggctacacacgtgctacaatggttggtacaacgagaagcgagatagagatgttaagcgaaactctaaaaaccaatctcagttcggattgtaggctgcaactcgcctacatgaagtcggagttgctagtaatcgcgaatcagaatgtcgcggtgaatgcgttcccgggtcttgtacacaccgcccgtcacaccatgggagttggcaatacccgaagccgccgatctaaccgcaaggaggaaggcgtcgaaggtagggttaatgactggggtgaagtcgtaacaaggtaacc

SEQ ID NO: 1432 - DNA, 1530 bp, Parvimonas sp.
  oral taxon 110
ttttaatagagagtttgatcctggctcaggacgaacgctggcggcgtgcttaacacatgcaagtcgaacgtgatttttgtggaaagcccttcggggacggaagcgaaatgaaagtggcgaacgggtgagtaacacgtgagcaacctaccttacacagggggatagccgttggaaacgacgattaataccgcatgagaccacaaagccacatggcttaggggtaaaagatttatcggtgtaagatgggctcgcgtctgattagctagttggaagggtaaaggcctaccaaggcaacgatcagtagccggtctgagaggatgaacggccacattggaactgagacacggtccaaactcctacgggaggcagcagtggggaatattgcacaatggggggaaccctgatgcagcgacgccgcgtgagcgaagaaggttttcgaatcgtaaagctctgtcctatgagaagataatgacggtatcataggaggaagccccggctaaatacgtgccagcagccgcggtaatacgtatggggcgagcgttgtccggaattattgggcgtaaagggtacgtaggcggccttttaagtcaggtgtgaaagcgtgaggcttaacctcattaagcacttgaaactggaaggcttgagtgaaggagaggaaagtggaattcctagtgtagcggtgaaatgcgtagatattaggaggaataccggtggcgaaggcgactttctggacttttactgacgctcaggtacgaaagcgtggggagcaaacaggattagataccctggtagtccacgccgtaaacgatgaatgctaggtgttgggagtcaaatctcggtgccgaagttaacacattaagcattccgcctggggagtacggtggcaacactgaaactcaaaggaattgacggggacccgcacaagcagcggagcatgtggtttaattcgaagcaacgcgaagaaccttaccaaggcttgacatatagttgagttattgagaaattgataagtccctcgggacaactatacaggtggtgcatggttgtcgtcagctcgtgtcgtgagatgttgggttaagtcccgcaacgagcgcaacccttatcttcagttaccagcatgtaatgatggggactctggagagactgccgatgacaaatcggaggaaggtggggatgacgtcaaatcatcatgccctttatgtcttgggctacacacgtgctacaatggttggtacaacgagaagctagacagtgatgttaagcaaaactctaaaaaccaatctcagttcggattgtaggctgcaactcgcctacatgaagtcggagttgctagtaatcgcgaatcagaatgtcgcggtgaatgcgttcccgggtcttgtacacaccgcccgtcacaccatgggagttggcaatacccgaagccgccgatctaaccgcaaggaggaaggcgtcgaaggtagggttaatgactggggtgaagtcgtaacaaggtagccgtatcggaaggtgcggctggatcacctcctttct

SEQ ID NO: 1433 - DNA, 1475 bp, Pasteurella bettyae
  modified_base (29)..(29): a, c, t, g, unknown or other
  modified_base (127)..(127): a, c, t, g, unknown or other
  modified_base (130)..(130): a, c, t, g, unknown or other
  modified_base (203)..(203): a, c, t, g, unknown or other
  modified_base (290)..(290): a, c, t, g, unknown or other
  modified_base (354)..(354): a, c, t, g, unknown or other
  modified_base (369)..(369): a, c, t, g, unknown or other
  modified_base (371)..(371): a, c, t, g, unknown or other
  modified_base (627)..(627): a, c, t, g, unknown or other
  modified_base (963)..(963): a, c, t, g, unknown or other
  modified_base (1264)..(1265): a, c, t, g, unknown or other
attgaagagtttgatcatggctcagattnaacgctggcggcaggcttaacacatgcaagtcgaacggtagcayaggggagcttgctccctgggtgacgagtggcggacgggtgagtaatgcttgggnatntggcttatggagggggataactacgggaaactgtagctaataccgcgtaatgtctacggactaaagggtgggnctatttggccacctgccatgagatgagcccaagtgggattaggtagttggtggggtaaaggcctaccaagccgacgatctctagctngtctgagaggatgaccagccacactggaactgagacacggtccagactcctacgggaggcagcngtggggaatattgcncnatggggggaaccctgatgcagccatgccgcgtgaatgaagaaggccttcgggttgtaaagttctttcggtgatgaggaaggcaggtattttaatagaatacttgattgacgttaatcacagaagaagcaccggctaactccgtgccagcagccgcggtaatacggagggtgcgagcgttaatcggaataactgggcgtaaagggcatgcaggcggttgtttaagtgagatgtgaaagccccgggcttaacctgggnattgcatttcagactggacagctagagtactttagggaggggtagaattccacgtgtagcggtgaaatgcgtagagatgtggaggaataccgaaggcgaaggcagccccttgggaatgtactgacgctcatatgcgaaagcgtggggagcaaacaggattagataccctggtagtccacgctgtaaacgatgtcgatttggggattgagcaataagcttggtgcgcgaagctaacgtgataaatcgaccgcctggggagtacggccgcaaggttaaaactcaaatgaattgacgggggcccgcacaagcggtggagcatgtggtttaattcgatgnaacgcgaagaaccttacctactcttgacatccatagaagaactcagagatgagtttgtgccttcgggagctatgagacaggtgctgcatggctgtcgtcagctcgtgttgtgaaatgttgggttaagtcccgcaacgagcgcaacccttatcctttgttgccagcgacatggtcgggaactcaaaggagactgccagtgataaactggaggaaggtggggatgacgtcaagtcatcatggcccttacgagtagggctacacacgtgctacaatggtgcatacagagggaagcgagcctgcnngggggagcgaatctcagaaagtgcatctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaacggaaacgggggcgtttaccacggtatgattc

SEQ ID NO: 1434 - DNA, 1544 bp, Pasteurella dagmatis
ttgaattgaagagtttgatcatggctcagattgaacgctggcggcaggcttaacacatgcaagtcgaacggtagcaggaagaaagcttgctttctttgctgacgagtggcggacgggtgagtaatgcttgggaatctggcttatggagggggataactgtgggaaactgcagctaataccgcgtagtatcgagagatgaaagggtgggaccttcgggccacctgccataagatgagcccaagtgggattaggtagttggtggggtaaaggcctaccaagccgacgatctctagctggtctgagaggatgaccagccacactgggactgagacacggcccagactcctacgggaggcagcagtggggaatattgcgcaatggggggaaccctgacgcagccatgccgcgtgaatgaagaaggccttcgggttgtaaagttctttcggtaatgaggaaggggtattattgaatagataatatcattgacgttaattacagaagaagcaccggctaactccgtgccagcagccgcggtaatacggagggtgcgagcgttaatcggaataactgggcgtaaagggcacgcaggcggacttttaagtgagatgtgaaatccccgagcttaacttgggaactgcatttcagactgggagtctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgtgctttatgcatggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccaaagaaggccgtagagatatggctgtgccttcgggaactttgagacaggtgctgcatggctgtcgtcagctcgtgttgtgaaatgttgggttaagtcccgcaacgagcgcaacccttatcctttgttgccagcgatttggtcgggaactcaaaggagactgccagtgacaaactggaggaaggtggggatgacgtcaagtcatcatggcccttacgagtagggctacacacgtgctacaatggtgcatacagagggcggcgagacggcgacgttgagcgaatctcagaaagtgcatctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttcgggagggcgtttaccacggtatgattcatgactggggtgaagtcgtaacaaggtaaccgtaggggaacctgcggttggatcacctcctta

SEQ ID NO: 1435 - DNA, 1545 bp, Pasteurella multocida
ttgaattgaagagtttgatcatggctcagattgaacgctggcggcaggcttaacacatgcaagtcgaacggtagcaggaagaaagcttgctttctttgctgacgagtggcggacgggtgagtaatgcttgggaatctggcttatggagggggataactgtgggaaactgcagctaataccgcgtattctctgaggaggaaagggtgggaccttagggccacctgccataagatgagcccaagtgggattaggtagttggtggggtaaaggcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtaatgaggaagggatgttgttaaatagatagcatcattgacgttaattacagaagaagcaccggctaactccgtgccagcagccgcggtaatacggagggtgcgagcgttaatcggaataactgggcgtaaagggcacgcaggcggacttttaagtgagatgtgaaatccccgagcttaacttgggaactgcatttcagactgggagtctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggctatatgcttggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgattcggtcgggaactcaaaggagactgccagtgacaaactggaggaaggtggggatgacgtcaagtcatcatggtccttacgagtagggctacacacgtgctacaatggtgcatacagagggcagcgagagtgcgagcttgagcgaatctcagaaagtgcatctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttcgggagggcgtttaccacggtatgattcatgactggggtgaagtcgtaacaaggtaaccgtaggggaacctgcggttggatcacctccttac

SEQ ID NO: 1436 - DNA, 1434 bp, Pediococcus acidilactici
tcgaacgaacttccgttaattgatcaggacgtgcttgcactgaatgagattttaatatgaagtgagtggcggacgggtgagtaacacgtgggtaacctgcccagaagcaggggataacacctggaaacagatgctaataccgtataacagagaaaaccgcctggttttcttttaaaagatggctctgctatcacttctggatggacccgcggcgcattagctagttggtgaggtaacggctcaccaaggcgatgatgcgtagccgacctgagagggtaatcggccacattgggactgagacacggcccagactcctacgggaggcagcagtagggaatcttccacaatggacgcaagtctgatggagcaacgccgcgtgagtgaagaagggtttcggctcgtaaagctctgttgttaaagaagaacgtgggtgagagtaactgttcacccagtgacggtatttaaccagaaagccacggctaactacgtgccagcagccgcggtaatacgtaggtggcaagcgttatccggatttattgggcgtaaagcgagcgcaggcggtcttttaagtctaatgtgaaagttcggctcaaccgaagaagtgcattggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgattactaagtgttggagggtttccgcccttcagtgctgcagctaacgcattaagtaatccgcctggggagtacgaccgcaaggttgaaactcaaaaaaattgacgggggcccgcacaagcggtggagcatgtggtttaattcgaagctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggacgacgtcaaatcatcatgccccttatgacctgggctacacacgtgctacaatggatggtacaacgagttgcgaaaccgcgaggtttagctaatctcttaaaaccattctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagccggtggggtaaccttttaggagctagc

SEQ ID NO: 1437 - DNA, 984 bp, Pediococcus pentosaceus
gtcgaacgaacttccgttaattgattatgacgtacttgtactgattgagattttaacacgaagtgagtggcgaacgggtgagtaacacgtgggtaacctgcccagaagtaggggataacacctggaaacagatgctaataccgtataacagagaaaaccgcatggttttcttttaaaagatggctctgctatcacttctggatggacccgcggcgtattagctagttggtgaggtaaaggctcaccaaggcagtgatacgtagccgacctgagagggtaatcggccacattgggactgagacacggcccagactcctacgggaggcagcagtagggaatcttccacaatggacgcaagtctgatggagcaacgccgcgtgagtgaagaagggtttcggctcgtaaagctctgttgttaaagaagaacgtgggtaagagtaactgtttacccagtgacggtatttaaccagaaagccacggctaactacgtgccagcagccgcggtaatacgtaggtggcaagcgttatccggatttattgggcgtaaagcgagcgcaggcggtcttttaagtctaatgtgaaagccttcggctcaaccgaagaagtgcattggaaactgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacaggattagataccctggtagtccatgccgtaaacgatgattactaagtgttggagggtttccgcccttcagtgctgcagctaacgcattaagtaatccgcctggggagtacgaccgcaaggttgaaactcaaaagaattgacgggggcccgcacaagcggtggagcatgtggtttaattcgaagctacgcgaagaaccttaccaggtcttgacatcttctgacagtc

SEQ ID NO: 1438 - DNA, 1393 bp, Peptococcus niger
gcctaatacatgcaagtcgaacggacgaggaaagagacctcttcggagtgacctttcccgagttagtggcggatgggtgagtaacgcgtgagtgacctgcccagcagtggggaataacagtgagaaatcattgctaataccgcatatcttacaagtgcttcatggtacctgtaagaaagacggccttcgtgctgtcgctgttggatggactcgcgtctgattagccagttggtggggtaacggcctaccaaagcaatgatcagtagccggcctgagagggtgaacggccacattgggactgagacacggcccaaactcctacgggaggcagcagtggggaatcttccgcaatgggcgcaagcctgacggagcaatgccgcgtgagtgaagaaggccttcgggttgtaaaactctgtcctcatccaagagaggggaaggtagtaactgacctttccaggacggtagatgaggaggaagccccggctaactatgtgccagcagccgcggtaaaacatagggggcaagcgttgtccggaatcactgggcgtaaagggcgcgcaggcggtctgttaagtcagatgtgaaaggttagggctcaaccctgaacgtgcatctgatactggcagacttgagtatggaagaggtaagtggaattcctagtgtagcggtgaaatgcgtagatattaggaggaacaccagtggcgaaggcgacttactgggccataactgacgctgaggcgcgaaagcgtggggagcaaacaggattagataccctggtagtccacgccgtaaacgatgggtactaggtgtcggaggtttcaagaccgtcggtgccgcagttaacacaataagtaccccgcctggggagtacggtcgcaagactgaaactcaaaggaattgacgggggcccgcacaagcggtggagcatgtggtttaattcgacgcaacgcgaagaaccttaccaagacttgacatcctgctgccgagtgatgtaatgtcacttttccttcgggacagcagagacaggtggtgcatggttgtcgtcagctcgtgtcgtgagatgttgggttaagtcccgcaacgagcgcaacccttgtcgtcagttgccatcattaagttgggcactctgacgagactgccgcagacaatgcggaggaaggtggggatgacgtcaaatcatcatgccccttatgtcttgggctacacacgtgctacaatggtcggtacagagggcagcgaaggagcgatccggagccaatctcacaaagccgatcccagttcggattgcaggctgcaactcgcctgcatgaagtcggaatgcgtagtaatcgcaggtcagcatactgcggtgaatacgttcccgggccttgtacacaccgcccgtcacaccacg

SEQ ID NO: 1439 - DNA, 1366 bp, Peptococcus sp.
  oral clone JM048
gagtttgattctggctcaggatgaacgctggcggcatgcctaacacatgcaagttgaacgagtagcgaacgggtgagtaacgcgtgggcaaccaaccttacactgggggataacacagagaaatttgtgctaataccgcataagaaaaagtggtgtaagacgggcccgcgtctgattagttagttggtgaggtaaaagcttaccaaggcaacgatcagtagccgacctgagagggtgatcggccacattgggactgagacacggcccaaactcctacgggaggcagcagtgggggatattgcacaatggagggaactctgatgcagcaatgccgcgtgaaggaagaaggttttcggattgtaaacttctatcagcagggaagatgacggtacttgactaagaagccccggctaactatgtgccagcagccgcggtaatacatagggggcaagcgttatccggaatgactgggtgtaaagggtgcgtaggcggtaaggtaagtctgatgtgaaagactggggctcaactccaggggtgcattggaaactatgttactagagtacaggagagggaagcggaattcctagtgtagcggtgaaatgcgtagatattaggaggaacaccggtggcgaaggcggctttctggactgactgacgctgaggcacgaaagcgtggggagcaaacaggattagataccctggtagtccacgctgtaaacgatgagtgctaggtgctggccggtcggtgccgaagttaacgcaataagcactccacctggggagtacggccgcaaggctgaaactcaaaggaattgacgggggcccgcacaagcggtggagcatgtggtttaattcgaagcaacgcgaagaaccttaccagatcttgacatcgacaggtggtgcatggttgtcgtcagctcgtgtcgtgagatgttaggttaagtcctgtaacgagcgcaacccttatgtttagtagccagcggccgggcactctgaacagactgccgtggagaacacggaggaaggcggggatgacgtcaaatcatcatgccccttatgatctgggctacacacgtgctacaatggcggacaaagggaagcgaaggggagacctggagcgaatccgagtccgtcccagttcggatgtagtctgcaactcgactacagaagttggaatcgctagtaatcgcagatcagcatgctgcggtgaatacgttcccgggccttgtacacaccgcccgtcacaccatgggagttgggagtgcccaaaagcagtgtccaggaagctgtctaaggcaagaccgatgactggggtgaagtcgtaacaaggtagccgtatcggaaggtgcggctggatcacctcctt

SEQ ID NO: 1440 - DNA, 1541 bp, Peptococcus sp.
  oral taxon 167
gagtttgatcctggctcaggacaaacgctggcggcatgcctaacacatgcaagtcgaacggacagaacagagaagcttttcggagtggaactggaaagttagtggcggatgggtgagtaacgcgtggacaacctaccttgtaaaggggaataacctcgagaaatcgaagctaataccccataataaccttgattcgcatgaagcaaggaggaaaggcggccttagagctgtcgatagaagatgggtccgcgtctgattagctagttggtgaggtaaaggctcaccaaggcgacgatcagtagccggcctgagagggtgaacggccacattgggactgagacacggcccaaactcctacgggaggcagcagtggggaatcttccgcaatgggcgaaagcctgacggagcaatgccgcgtgagtgaagaaggccttcgggttgtaaaactctgtcctagacgaagagagagtattgtgagtaactgacaatgctaggacggtagactaggaggaagccccggctaactatgtgccagcagccgcggtaaaacatagggggcaagcgttgtccggaatcactgggcgtaaagggcgcgcaggcggtaaattaagtcaggtgtgaaagttcggggctcaaccccgtgattgcacctgatactgataaactagagtgttggagaggtaagtggaattcctagtgtagcggtggaatgcgtagatattaggaggaacaccagtggcgaaggcgacttactggccaataactgacgctgaggcgcgaaagcgtggggagcaaacaggattagataccctggtagtccacgccgtaaacgatgagtactaggtgttggttgtttcgaaacaatcggtgccgcagtaaacacaataagtactccgcctggggagtacggtcgcaagactgaaactcaaaggaattgacgggggcccgcacaagcggtggagcatgtggtttaattcgacgcaacgcgaagaaccttaccaagacttgacatcctcttgccgggatatgtaatgtatccttttcttcggaacaagagagacaggtggtgcatggttgtcgtcagctcgtgtcgtgagatgttgggttaagtcccgcaacgagcgcaacccttgttgttagttgccatcattaagttgggcactctaacaagactgccggtgacaaaccggaggaaggtggggatgacgtcaaatcatcatgccccttatgtcttgggctacacacgtgctacaatggtcggtacagagggcagcaagagagtgatcttgagcgaatctcaaaaagccgatcccagttcggattgtaggctgcaactcgcctacatgaagtcggaatcgctagtaatcgcaggtcagcatactgcggtgaatacgttcccgggccttgtacacaccgcccgtcacaccacgaaagttggtaacatccgaagccggtgatctaacctgcaaaggaggaagccgcccacggtgggatcgatgattggggtgaagtcgtaacaaggtagccgtatcggaaggtgc

SEQ ID NO: 1441 - DNA, 1384 bp, Peptoniphilus asaccharolyticus
  modified_base (146)..(146): a, c, t, g, unknown or other
  modified_base (182)..(184): a, c, t, g, unknown or other
  modified_base (416)..(416): a, c, t, g, unknown or other
  modified_base (448)..(448): a, c, t, g, unknown or other
  modified_base (620)..(620): a, c, t, g, unknown or other
  modified_base (649)..(649): a, c, t, g, unknown or other
  modified_base (890)..(890): a, c, t, g, unknown or other
  modified_base (1208)..(1208): a, c, t, g, unknown or other
agagtttgatcctggctcaggacgaacgctggcggcgcgcttaacacatgcaagtcgagcgatgaagctttaacagattccttcgggatgaagataaagcggattagcggcggacgggtgagtaacacgtgagtaacctgcctttnacatcgggatagcctcgggaaaccgggattaatacnnnataaaatcctacatacacatgtacataggttcaaaactacggtggtcttagatggactcgcgtcccattagctagttggtggagtaaaagcctaccaaggcgacgatgggtagccggcctgagagggtgaccggccacattggaactgagaaacggtccaaactctacgggaggcagcagtggggaatattgcacaatggaggaaactctgatgcagcgacgccgcgtgaangaagaaggccttcgggcagtaaaggtcttttntatgggaagataatgacggtaccataaggaaaagcaccggctgcatacgtgccagcagccgcggtaatacgtagggggctagcgttgtccggaatcactgggcgtaaagggttcgcaggcggaaatgcaagtcagatgtaaaaggcagtagcttaactactgtaagcatttnaaactgtatatcttgagaagtgtagaggnaagtggaatttttagtgtagcggtgaaatgcgtagatattaaaaagaataccggtggcgaaggcgacttactgggcacattctgacgctgaggaacgaaagcgtgggtagcaaacaggattagataccctggtagtccacgctgtaaacgatgagtgctaggtgtcggcaaaagtcggtgccgcagttaacacattaagcactccgcctggggagtacgtgcgcaagtatgaaactcaaangaatcaaaggaatcgacggggacccgcacaagcagcggagatgtggtttaattcgaagcaacgcgaagaaccttaccagggcttgacatatagaggacatatttagagataaataattcttcttcggaagcctctatacaggtggtgcatggttgtcgtcagctcgtgtcgtgagatgttgggttaagtcccgcaacgggcgcaacccttatatctagttgccagcatttcggatgggaactctagatagactgccgatgacaaatcggaggaaggtggggatgacgtcaaatcatcatgccctatatgccctgggcnacacacgtgctacaatggaaggtacaaagggaagccaaatcgcgaggtggagcaaacctcaaaaagcctttcccagttcggattgttctctgcaactcgagtacatgaagctggagttgctagtaatcgtagatcagaatgctgcggtgaatgcgttcccgggtcttgtacacacc

SEQ ID NO: 1442 - DNA, 1386 bp, Peptoniphilus duerdenii
acagatcccttcggggtgaagatgaaatggattagcggcggacgggtgagtaacacgtgagtaacctgcctttgacattgggatagcctcgggaaactgggattaataccaaatgatactatttgaccacatggttggatagtcaaagaaattcggtcaaagatggactcgcggctgattagctagttggtgaggtaacggcccaccaaggcgacgatcagtagccggcctgagagggtgaccggccacattggaactgagacacggtccaaactcctacgggaggcagcagtggggaatattgcacaatgggggaaaccctgatgcagcgacgccgcgtgagcgaagaaggccttcgggtcgtaaagctcttttatgagggaagataatgacggtacctcaagaaaaagccccggctaactacgtgccagcagccgcggtaatacgtagggggctagcgttgtccggaatcactgggcgtaaagggttcgcaggcggaataacaagtcagatgtgaaaggcatgggctcaacccatgtaagcatttgaaactgtaattcttgagaagtggagaggtaagtggaattcctagtgtagcggtgaaatgcgtagatattaggaggaatacctgtggcgaaggcgacttactggacacaaatctgacgctgaggaacgaaagcgtgggtagcaaacaggattagataccctggtagtccacgccgtaaacgatgagtgctaggtgtcgggggagacctcggtgccggcgttaacacaataagcactccgcctggggagtacgtgcgcaagcatgaaactcaaaggaattgacggggacccgcacaagcagcggagcatgtggtttaattcgacgcaacgcgaagaaccttaccagggcttgacatactgaggacgtacttagagataagtattctccttcgggagcctcaatacaggtggtgcatggttgtcgtcagctcgtgtcgtgagatgttcagttaagtctggcaacgagcgcaacccttacctttagttaccagcatttcggatggggactctaaagggactgccgatgataaatcggaggaaggtggggatgacgtcaaatcatcatgccctatatgccctgggctacacacgtgctacaatggtcggaacagagggaagcaacagagcgatctcaagcaaatctcataaatccgatcccagttcggattgcactctgcaactcgagtgcatgaagtcggagttgctagtaatcgcagatcagcatgctgcggtgaatgcgttcccgggtcttgtacacaccgcccgtcacaccatgggagcctgtaatacccgaagccggtgagccaaccgcaaggaggcagccgtcgaaggtaggatagg

SEQ ID NO: 1443 - DNA, 1476 bp, Peptoniphilus harei
gacgaacgctggcggcgcgcttaacacatgcaagtcgagcgatgaaatcttgacagatccttcggggtgaagataagatggattagcggcggacgggtgagtaacacgtgagtaacctgccttagacattgggatagcctcgggaaaccgggattaataccaaatgaaatcataggtgcccatgcactaatgatcaaaactccggtggtctaagatggactcgcgtcccattagctagttggtgaggtaacggcccaccaaggcgacgatgggtagccggcctgagagggtgaacggccacattggaactgagaaacggtccaaactcctacgggaggcagcagtggggaatattgcacaatggagggaactctgatgcagcgacgccgcgtgaacgatgaaggctttcgagtcgtaaagttcttttatatgggaagataatgacggtaccataagaaaaagccccggctaactacgtgccagcagccgcggtaatacgtagggggctagcgttgtccggaatcactgggcgtaaagggttcgcaggcggaaatgcaagtcagatgtaaaaggcagtagcttaactactgtaagcatttgaaactgcatatcttgagaagagtagaggtaagtggaatttttagtgtagcggtgaaatgcgtagatattaaaaagaataccggtggcgaaggcgacttactgggctcattctgacgctgaggaacgaaagcgtgggtagcaaacaggattagataccctggtagtccacgctgtaaacgatgagtgctaggtatcggaataattcggtgccgcagttaacacattaagcactccgcctggggagtacgtgcgcaagcatgaaactcaaaggaattgacggggacccgcacaagcagcggagcatgtggtttaattcgaagcaacgcgaagaaccttaccagggcttgacatactgaggaccggtatagagatataccctcttcttcggaagcctcaatacaggtggtgcatggttgtcgtcagctcgtgtcgtgagatgttcagttaagtctggcaacgagcgcaacccctatctttagttaccagcatttcggatggggactctaaagagactgccgatgataaatcggaggaaggtggggatgacgtcaaatcatcatgccctatatgccctgggctacacacgtgctacaatggaagatacaaagggaagcgagatagtgatattaagccaacctcaaaaagtctttctcagttcggattgtactctgcaactcgagtacatgaagatggagttgctagtaatcgcagatcagcatgctgcggtgaatgcgttcccgggtcttgtacacaccgcccgtcacaccatggaagcttgtaatacccgaagcctgcgagcgaaccttagggaagcagcagtcgaaggtaggataggtgactggggtgaagtcgtaacaaggtagccgtatcggaagg

SEQ ID NO: 1444 - DNA, 1423 bp, Peptoniphilus indolicus
  modified_base (162)..(162): a, c, t, g, unknown or other
  modified_base (1214)..(1214): a, c, t, g, unknown or other
cgcgcctaacacatgcaagtcgagcgatgaagacataaccgacaccttcgggaagaagttaagttggattagcggcggacgggtgagtaacacgtgagtaacctgcctttgacacgggggatagccaccggaaacggtgattaatacccgatgaaatcgtantgacacatgtcataacgatcaaagtgaattagcggtcaaagatggactcgcgtctgattaattagttggtgaggtaacggctcaccaagatagcgatcagtagccggcctgagagggtgaacggccacattggaactgagaaacggtccaaactcctacgggaggcagcagtggggaatattgcacaatgggggaaaccctgatgcagcgacgccgcgtgagcgaagaaggatttcgattcgtaaagctctgtcctatgggaagataatgacggtaccataggaggaagccccggctaactacgtgccagcagccgcggtaatacgtagggggcgagcgttgtccggaatcactgggcgtaaagggttcgcaggcggtttagaaagtcagatgtgaaaggcgagggctcaaccctcgtaagcatttgaaacttctaaacttgagtagtgaagaggtaagtggaattcctagtgtagcggtgaaatgcgtagatattaggaggaataccggtggcgaaggcgacttactggtcacaaactgacgctgaggaacgaaagcgtgggtagcaaacaggattagataccctggtagtccacgccgtaaacgatgagtgctaggtgtccggaggatttcggtgccgcagttaacacaataagcactccgcctggggagtacgtgcgcaagcatgaaactcaaaggaattgacggggacccgcacaagcagcggagcatgtggtttaattcgaagcaacgcgaagaaccttaccagggcttgacataatattgacccctctagagatagaggtttcccttcggggacagtattacaggtggtgcatggttgtcgtcagctcgtgtcgtgagatgttgggttaagtcccgcaacgagcgcaacccttacctttagttgccagcatgtaaagatgggaactctaaagggactgccgatgataaatcggaggaaggtggggatgacgtcaaatcatcatgccctttatgtcctgggctacacacgtgctacaatggtcggaacaaagagcgggcaagctagngatagcaagcgaatctcaaaaagccgatctcagttcggattgttctctgcaactcgagaacatgaagtcggagttgctagtaatcgcagatcagaatgctgcggtgaatgcgttcccgggtcttgtacacaccgcccgtcacaccatgggagttggcaatacccgaagtcgtcgagctaaccgcaaggaagcagacgccgaaggtaggg

SEQ ID NO: 1445 - DNA, 1480 bp, Peptoniphilus ivorii
gacgaacgctggcggcgcgcctaacacatgcaagtcgagcgatgaacctcttcggatcccttcggggtgaagaagagcggattagcggcggacgggtgagtaacgcgtgaggaacctgcctctcacaacgggatagcctcgggaaaccgggattaataccgtatgagaccacagtaacgcctgttacagtggttaaagtcacagcggtgagagatggcctcgcgtctgattagctagttggtggggtaacggcctaccaaggctgcgatcagtaaccggcctgagagggtgaacggtcacattggaactgagacacggtccaaactcctacgggaggcagcagtggggaatcttgcacaatgggggcaaccctgatgcagcgacgccgcgtgagcgatgaaggctttcgagtcgtaaagctctgtcctatgggaagataatgacggtaccataggaggaagccccggctaactacgtgccagcagccgcggtaatacgtagggggcgagcgttgtccggaattactgggcgtaaagggttcgcaggcggctcggcaagtccgatgtaaaaggcgaaggcttaaccttcgyaagcatcggaaactgtcgagcttgagtgaaggagaggcaagtggaattcctagtgtagcggtggaatgcgtagatattaggaggaataccggtggcgaaggcgacttgctggacttcaactgacgctgaggaacgaaagcgtgggtagcaaacaggattagataccctggtagtccacgctgtaaacgatgagtgctaggtgtcgggggtcaaacctcggtgccgtcgttaacacaataagcactccgcctggggagtacgtgcgcaagcatgaaactcaaaggaattgacggggacccgcacaagcagcggagcatgtggtttaattcgaagcaacgcgaagaaccttaccgggacttgaaatattgtcgccaattttagagataaaatgttttcttcggaaacggcaatacaggtggtgcatggttgtcgtcagctcgtgtcgtgagatgttgggttaagtcccgcaacgagcgcaacccttactttcagttgccagcgcattatggcgggaactctggaaggactgccgatgataaatcggaggaaggtggggatgacgtcaaatcatcatgccctttatgtcccgggctacacacgtgctacaatggtcggtacagagggcagcgagacagcgatgttaagcgaatctcaaaaagccgatcccagttcggattgcaggctgcaactcgcctgcatgaagtcggagttgctagtaatcgcggatcagaatgccgcggtgaatgcgttcccgggtcttgtacacaccgcccgtcacaccatgggagttggcaatacccgaagccagcgagccaaccgtaaggaggcagctgtcgaaggtagggttaatgactggggtgaagtcgtaacaaggtagccgtatcggaagg

SEQ ID NO: 1446 - DNA, 1531 bp, Peptoniphilus lacrimalis
ttttaattgagagtttgatcctggctcaggacgaacgctggcggcgcgcttaacacatgcaagtcgagcgatgaaatcttaacagaacccttcggggcgaagataagacggattagcggcggacgggtgagtaacacgtgagtaacctgccttttacacagggatagcctcgggaaaccgggattaaaacctgatgaaactatcaaatcacatgattaagaaagttaaaactccggtggtaaaagatggactcgcgtcccattagctagttggtgaaggtaacggcccaccaaggcaacgatgggtagccggcctgagagggtgaacggccacattggaactgagaaacggtccaaactcctacgggaggcagcagtggggaatattgcacaatgggggaaaccctgatgcagcgacgccgcgtgagcgaagaaggccttcgggtcgtaaagctcttttatatgggaagataatgacggtaccataagaaaaagccccggctaactacgtgccagcagccgcggtaatacgtagggggctagcgttgtccggaatcactgggcgtaaagggttcgcaggcggcaatgcaagtcagatgtaaaaggcaaaggctcaacctttgtaagcatctgaaactgtatagcttgagaagtgtagaggcaagtggaatttttagtgtagcggtgaaatgcgtagatattaaaaagaataccggtggcgaaggcgacttgctgggcacaatctgacgctgaggaacgaaagcgtggggagcaaacaggattagataccctggtagtccacgccgtaaacgatgagtgctaggtgtcggtataaatcggtgccgcagttaacacaataagcactccgcctggggagtacgtgcgcaagcatgaaactcaaaggaattgacggggacccgcacaagcagcggagcatgtggtttaattcgaagcaacgcgaagaaccttaccagggcttgacatataagagacgaacttagagataagttttcttcttcagaagcccttatacaggtggtgcatggttgtcgtcagctcgtgtcgtgagatgttgggttaagtcccgcaacgagcgcaacccttattactagttaccagcatttcggatggggactctagaaagactgccgatgataaatcggaggaaggtggggatgacgtcaaatcatcatgccctatatgccctgggcaacacacgtgctacaatggccgtaacaaagagaagcgaaatcgcaaggtcaagcaaacctcaaaaagacggtctcagttcggattgttctctgcaactcgagaacatgaagtcggagttgctagtaatcgcagatcagaatgctgcggtgaatgcgttcccgggtcttgtacacaccgcccgtcacaccatgggagcttgtaatacccgaagcctgtgagctaaccgcaagggagcagcagtcgaaggtaggacaagtgactggggtgaagtcgtaacaaggtagccgtatcggaaggtgcggctggatcacctcctttct

SEQ ID NO: 1447 - DNA, 1386 bp, Peptoniphilus sp.
  JC140
attagcggcggacgggtgagtaacacgtgagtaacctgccttagacattgggatagcctcgggaaaccgggattaataccgaataacatcacatagacacatgtcattgtgatcaaaactccggtggtctaagatggactcgcgtcccattagctagttggtagggtaacggcctaccaaggcgacgatgggtagccggcctgagagggtgaacggccacattggaactgagaaacggtccaaattcctacgggaggcagcagtggggaatattgcacaatgggggaaaccctgatgcagcgacgccgcgtgaacgaagaaggctttcgagtcgtaaagttcttttatatgggaagataatgacggtaccataagaaaaagccccggctaactacgtgccagcagccgcggtaatacgtagggggctagcgttgtccggaatcactgggcgtaaagggttcgcaggcggaaatgcaagtcagatgtaaaaggcagtagcttaactactgtaagcatttgaaactgcatatcttgagaagagtagaggtaagtggaatttttagtgtagcggtgaaatgcgtagatattaaaaagaataccggtggcgaaggcgacttactgggctcatctgacgctgaggaacgaaagcgtgggtagcaaacaggattagataccctggtagtccacgctgtaaacgatgagtgctaggtgtcggcgtaagtcggtgccgcagttaacacaataagcactccgcctggggagtacgtgcgcaagcatgaaactcaaaggaattgacggggacccgcacaagcagcggagcatgtggtttaattcgaagcaacgcgaagaaccttaccaaggcttgacatactgaggaaagacttagagataagtccctctcttcggagacctcaatacaggtggtgcatggttgtcgtcagctcgtgtcgtgagatgttgggttaagtcccgcaacgagcgcaacccttatctttagttgccagcatttcggatgggaactctaaagagactgccgatgataaatcggaggaaggtggggatgacgtcaaatcatcatgccctatatgccttgggctacacacgtgctacaatggaaggtacaaagggaagcaaaatagtgatattaagcaaacctcaaaaagcctttctcagttcggattgtactctgcaactcgagtacatgaagatggagttgctagtaatcgcagatcagaatgctgcggtgaatgcgttcccgggtcttgtacacaccgcccgtcacaccatgggagcttgtaatacccgaagcctgcgagcgaaccgtaaggaagcagcagtcgaaggtaggataagtgactggggtgaagtcgtaacaaggtagccgta

SEQ ID NO: 1448 - DNA, 1414 bp, Peptoniphilus sp.
  gpac007
  modified_base (365)..(365): a, c, t, g, unknown or other
  modified_base (378)..(378): a, c, t, g, unknown or other
  modified_base (516)..(516): a, c, t, g, unknown or other
  modified_base (624)..(624): a, c, t, g, unknown or other
atgcaagtcgagcgatgaacattgaatgwtcccttcggggtgatttcgatcggattagcggcgaacgggtgagtaacgcgtgaggaacctgcctcttacaacgggatagcctcgggaaaccgggattaataccgtataagactccgacatctcctggtgatgaagtcaaagcgttagcggtaagagatggcctcgcgtctgattagttagttggcggggtaacggcccaccaagacgacgatcagtaaccggcctgagagggtgaacggtcacattggaactgagacacggtccaaactcctacgggaggcagcagtggggaatcttgcacaatgggggcaaccctgatgcagcgacgccgcktngagcgatgaaggntttcgaatcgtaaagctctgtcctatgggaagataatgacggtaccwtgggaggaagccccggctaactacktgccagcagccgcggtaatacgtagggggcgagcgttgtccggaattactgggcgtaaaggkttcncagscggccatggcaaagtccgatgtaaaaggcgaargctcaaccttcgtaagcatcggraactgtcaagcttgagtgaaggagaggcaagtggaattcctagtgtanccggtggaatgcgtagatattaggaggaataccggtggcgaaggcgacttgctggacttcaactgacgctgaggaacgaaagcgtgggtagcaaacaggattagataccctggtagtccacgccgtaaacgatgagtgctaggtgtcgggggtcaaacctcggtgccgccgttaacacaataagcactccgcctggggagtacgtgcgcaagcatgaaactcaaaggaattgacggggacccgcacaagcagcggagcatgtggtttaattcgaagcaacgcgaagaaccttaccaggacttgaaatactagcgcccgctttagagataaagttttttcttcggaaacgctaatacaggtggtgcatggttgtcgtcagctcgtgtcgtgagatgttgggttaagtcccgcaacgagcgcaacccttacttttagttgccagcacgtaatggtgggaactctaaagggactgccgatgataaatcggaggaaggtggggatgacgtcaaatcatcatgccctttatgtcctgggctacacacgtgctacaatggtcggtacagagggcagcgaaagagcgatctcaagcgaatctcaaaaagccgatcccagttcggattgcaggctgcaactcgcctgcatgaagtcggagttgctagtaatcgcgaatcagaatgtcgcggtgaatgcgttcccgggtcttgtacacaccgcccgtcacaccatgggagttggcaatacccgaagccagcgagcccaaccgcaacggagcagctgtcgaatgtagggt

SEQ ID NO: 1449 - DNA, 1453 bp, Peptoniphilus sp.
  gpac018A
gacgaacgctggcggcgcgcctaacacatgcaagtcgagcgatgaaagtcgttctgatccttcgggtgatgaacttctggattagcggcgaacgggtgagtaacgcgtgaggaacctgcctcttacaacgggatagcctcgggaaaccgggattaataccgtataagactccgacatctcatgatgatgaagtcaaagcgttagcggtaagagatggcctcgcgtctgattagctggttggcggggtaacggcccaccaaggcgacgatcagtaaccggcctgagagggtgaacggtcacattggaactgagacacggtccaaactcctacgggaggcagcagtggggaatcttgcacaatgggggcaaccctgatgcagcgacgccgcgtgagcgattgaaggttttcgaatcgtaaagctctgtcctatgggaagataatgacggtaccataggaggaagccccggctaactacgtgccagcagccgcggtaatacgtagggggcgagcgttgtccggaattactgggcgtaaagggttcgcaggcggcatggcaagtccgatgtaaaaggcgaaggctcaaccttcgtaagcatcggaaactgtcaagcttgagtgaaggagaggcaagtggaattcctagtgtagcggtggaatgcgtagatattaggaggaataccggtggcgaaggcgacttgctggacttcaactgacsgtgagaaacgaaagcgtgggtagcaaacaggattagataccctggtagtccacgccgtaaacgatgagtgctaggtgtcggggtcaaacctcggtgccgccgttaacacaataagcactccgcctggggagtacgtgcgcaagcatgaaactcaaaggaattggacgggggacccgcacaaagcagcggagcatgtggtttaattcgaagcaacgcgaagaaccttaccaggacttgaaatactagcgcccgctttagagataaagttttttcttcggaaacgctaatacaggtggtgcatggttgtcgtcagctcgtgtcgtgagatgttgggttaagtcccgcaacgagcgcaacccttacttttagttgccagcacgtaatggtgggaactctaaagggactgccgatgataaatcggaggaaggtggggatgacgtcaaatcatcatgccctttatgtcctgggctacacacgtgctacaatggtcggtacagagggcagcgaacgagcgatcgcaagcgaatctcaaaaagccgatcccagttcggattgcaggctgcaactcgcctgcatgaagtcggagttgctagtaatcgcagatcagaatgctgcggtgaatgcgttcccgggtcttgtacacaccgcccgtcacaccatgggagttggcaatacccgaagccagcgagccaaccgyaaggaggcagctgtcgaaggtagggttaatgactggggtg

SEQ ID NO: 1450 - DNA, 1459 bp, Peptoniphilus sp.
  gpac077
  modified_base (473)..(473): a, c, t, g, unknown or other
  modified_base (553)..(553): a, c, t, g, unknown or other
gacgaacgctggcggcgcgcttaacacatgcaagtcgagcgatgaaatcttaacagaacccttcggggcgaagataagacggattagcggcggacgggtgagtaacacgtgagtaacctgccttttacacagggatagcctcgggaaaccgggattaaaacctgatgaaactatcaaatcacatgattaagaaagttaaaactccggtggtaaaagatggactcgcgtcccattagctagttggttgaaggtaacggccaccaaggcaacgatgggtagccggcctgagagggtgaacggccacattggaactgagaaacggtccaaactcctacgggaggcagcagtggggaatattgcacaatgggggaaaccctgatgcagcgacgccgcgtgagcgaagaaggccttcgggtcgtaaagctctttatatatgggaagataatgacggtaccataagaaaaagccccggntaactacgtagccagcagccgcggtaatacgtagggggctagacgttgtccggaatcactgggacgtaaagggttcgcangcggcaatgcaagtcagatgtaaaaaggcaaaggctcaaacatttgtaagcatctgaaactgtatagcttgaactttaaggcgccaagggaattttctagtcaccggtaaaacgccgtagatataaagagaaatcccgtggccgaaggcgacctctggggcaacaaatctggaccctgaggaacgaaagcttggggaccaaacaggataagatacccctggtagtccacgccgtaaacgatgagtgctaggtgtcggtataaatcggtcccgcagttaacacaataagcactccgccctggggagtacgtgcgcaagcatgaaactcaaaggaattgacggggacccgcacaagcagcggagcatgtggtttaattcgaagcaacgcgaagaaccttaccagggcttgacatataagagacgaacttagagataagttttcttcttcggaagcccttatacaggtggtgcatggttgtcgtcagctcgtgtcgtgagatgttgggttaagtcccgcaacgagcgcaacccttattactagttaccagcatttcggatggggactctagaaagactgccgatgataaatcggaggaaggtggggatgacgtcaaatcatcatgccctatatgccctgggcaacacacgtgctacaatggccgtaaccaaagagaagcgaaatcgccaaggtcaagcaaacctcaaaaagacggtctcagttcggattgttctctgcaactcgagaacatgaagtcggagttgctagtaatcgcagatcagaatgctgcggtgaatgcgttcccgggtcttgtacacaccgcccgtcacaccatgggagcttgtaatacccgaagcctgtgagctaaccgcaaggaagcagcagtcgaagtagacaagtgactgggtg

SEQ ID NO: 1451 - DNA, 1445 bp, Peptoniphilus sp.
  gpac148
  modified_base (1437)..(1437): a, c, t, g, unknown or other
gacgaacgctggcggcgcgcctaacacatgcaagtcgagcgatgaaattttaacggatcttttcggagagaagataaaatggattagcggcggacgggtgagtaacacgtgaggaacctgcctttcacaaggggatagcctcgggaaaccgggattaataccctatgatacaatcaagtctcctgatttaattgttaaagtgatagcggtgaaagatggcctcgcgtctgattagctagttggtgagataaaagcccaccaaggcgatgatcagtaaccggcctgagagggtgaacggtcacattggaactgagacacggtccaaactcctacgggaggcagcagtggggaatattgcacaatggagggaactctgatgcagcgacgccgcgtgagcgatgaaggctttcgagtcgtaaagctctgtcctatgggaagataatgacggtaccataggaggaagccccggctaactacgtgccagcagccgcggtaatacgtagggggcgagcgttgtccggaatcactgggcgtaaagggttcgcaggcggtttaccaagtccgatgtgaaaggcatgggcttaacccatgtaagcattagaaactggtaaacttgagttaaggagaggtaagtggaattcctagtgtagcggtgaaatgcgtagatattaggaagaataccggtggcgaaggcgacttactggacttaaactgacgctgaggaacgaaagcgtggggagcaaacaggattagataccctggtagtccacgctgtaaacgatgagtgctaggtgtcgggggaactcggtgccgcagttaacacattaagcactccgcctggggagtacgtgcgcaagcatgaaactcaaaggaattgacggggacccgcacaagcagcggagcatgtggtttaattcgaagcaacgcgaagaaccttaccaaggctagacattttactgcccggtctagagataggccctttcttcggaacagtaaaacaggtggtgcatggttgtcgtcagctcgtgtcgtgagatgttgggttaagtcccgcaacgagcgcaaccctcacctttagttgccagcatgtaacgatgggaactctaaagggactgccgatgataaatcggaggaaggtggggatgacgtcaaatcatcatgccctttatgccttgggctacacacgtgctacaatggtcggtacacagagcagcttaggagcgatctgaagcgaatctcaaaaagccgatctcagttcggattgcaggctgcaactcgcctgcatgaagtcggagttgctagtaatcgcgaatcagaatgtcgcggtgaatgcgttcccgggtcttgtacacaccgcccgtcacaccatgggagttggtaatacccgaagccgccgagctaaccgtttggasgcaggcgtcgaaggtaggatcaatnactgggtg

SEQ ID NO: 1452 - DNA, 1533 bp, Peptoniphilus sp.
  oral taxon 386
tttcaattgagagtttgatcctggctcaggacgaacgctggcggcgcgcctaacacatgcaagtcgagcgatgaaaaggatttggagttcttcgggacaaagaaaccttggattagcggcggacgggtgagtaacacgtgagtaacctgcctttgacatggggatagcctcgggaaaccgtgattaatacccaataacatttccaagtcgcatgacatgggaatcaaagcgtttagcggtcaaagatggactcgcgtctgattaattagttggtgaggtaacggctcaccaagatagcgatcagtagccggcctgagagggtgaacggccacattggaactgagagacggtccaaactcctacgggaggcagcagtggggaatattgcacaatggggggaaccctgatgcagcgacgccgcgtgagcgaagaaggttttcgaatcgtaaagctctgtcctatgggaagataatgacggtaccataggaggaagccccggctaactacgtgccagcagccgcggtaatacgtagggggctagcgttgtccggaatcactgggcgtaaagggttcgcaggcggaaaagcaagtcaggtgtgaaaggcgagggcttaaccctcgtaagcatttgaaactgtttttcttgagatgtggagaggtaagtggaattcctagtgtagcggtgaaatgcgtagatattaggaggaataccggtggcgaaggcgacttactggacacaaactgacgctgaggaacgaaagcgtggggagcaaacaggattagataccctggtagtccacgctgtaaacgatgagtgctaggtgtcgggagtaatctcggtgccgcagtaaacacaataagcactccgcctggggagtacgtacgcaagtatgaaactcaaaggaattgacggggacccgcacaagcagcggagcatgtggtttaattcgaagcaacgcgaagaaccttaccagggcttgacatatagcggacatatttagagataaatacttttcttcggaaaccgctatacaggtggtgcatggttgtcgtcagctcgtgtcgtgagatgttgggttaagtcccgcaacgagcgcaacccttacctttagttgccagcatgtaaagatgggaactctaaagggactgccgatgataaatcggaggaaggtggggatgacgtcaaatcatcatgccctatatgccctgggctacacacgtgctacaatggtcggaacaaagggtagcaaacttgtgaaagtaagcaaatctcaaaaagccgatctcagttcggattgttctctgcaactcgagaacatgaagtcggagttgctagtaatcgcagatcagaatgctgcggtgaatgcgttcccgggtcttgtacacaccgcccgtcacaccatgggagttggcaatacccgaagcctgtgagctaaccttaggggagcagcagtcgaaggtagggttaatgactggggtgaagtcgtaacaaggtagccgtatcggaaggtgcggctggatcacctcctttct

SEQ ID NO: 1453 - DNA, 1531 bp, Peptoniphilus sp.
  oral taxon 836
ttttaattgagagtttgatcctggctcaggacgaacgctggcggcgcgcttaacacatgcaagtcgagcgatgaaatcttaacagaacccttcggggcgaagataagacggattagcggcggacgggtgagtaacacgtgagtaacctgccttttacacagggatagcctcgggaaaccgggattaaaacctgatgaaactatcaaatcacatgattaagaaagttaaaactccggtggtaaaagatggactcgcgtcccattagctagttggtgaaggtaacggcccaccaaggcaacgatgggtagccggcctgagagggtgaacggccacattggaactgagaaacggtccaaactcctacgggaggcagcagtggggaatattgcacaatgggggaaaccctgatgcagcgacgccgcgtgagcgaagaaggccttcgggtcgtaaagctcttttatatgggaagataatgacggtaccataagaaaaagccccggctaactacgtgccagcagccgcggtaatacgtagggggctagcgttgtccggaatcactgggcgtaaagggttcgcaggcggcaatgcaagtcagatgtaaaaggcaaaggctcaacctttgtaagcatctgaaactgtatagcttgagaagtgtagaggcaagtggaatttttagtgtagcggtgaaatgcgtagatattaaaaagaataccggtggcgaaggcgacttgctgggcacaatctgacgctgaggaacgaaagcgtggggagcaaacaggattagataccctggtagtccacgccgtaaacgatgagtgctaggtgtcggtataaatcggtgccgcagttaacacaataagcactccgcctggggagtacgtgcgcaagcatgaaactcaaaggaattgacggggacccgcacaagcagcggagcatgtggtttaattcgaagcaacgcgaagaaccttaccagggcttgacatataagagacgaacttagagataagttttcttcttcggaagcccttatacaggtggtgcatggttgtcgtcagctcgtgtcgtgagatgttgggttaagtcccgcaacgagcgcaacccttattactagttaccagcatttcggatggggactctagaaagactgccgatgataaatcggaggaaggtggggatgacgtcaaatcatcatgccctatatgccctgggcaacacacgtgctacaatggccgtaacaaagagaagcgaaatcgcaaggtcaagcaaacctcaaaaagacggtctcagttcggattgttctctgcaactcgagaacatgaagtcggagttgctagtaatcgcagatcagaatgctgcggtgaatgcgttcccgggtcttgtacacaccgcccgtcacaccatgggagcttgtaatacccgaagcctgtgagctaaccgcaaggaagcagcagtcgaaggtaggacaagtgactggggtgaagtcgtaacaaggtagccgtatcggaaggtgcggctggatcacctcctttct

SEQ ID NO: 1454 - DNA, 1476 bp, Peptostreptococcaceae bacterium ph1
tgatcctggctcaggacgaacgctggcggcgtgcctaacacatgcaagtcgagcgatgaaaccttaacagactccttcgggatgaagattaggtggattagcggcggacgggtgagtaacacgtgagtaacctgcctttgacacagggatagccatgggaaaccgtgattaataccagatgaaatctaaactacacatgtagcaaagatcaaagcgaccaagcggtcaaagatggactcgcgcctgattagctagttggtgagataaaagctcaccaaggcaacgatcagtagccggcctgagagggtgaccggccacattggaactgagacacggtccaaactcctacgggaggcagcagtggggaatattgcacaatggggggaaccctgatgcagcgacgccgcgtgagcgaagaagggattcgtttcgtaaagctctgtcctatgggaagataatgacggtaccatagaagaaagccccggctaactacgtgccagcagccgcggtaatacgtagggggcgagcgttgtccggaatcactgggcgtaaagggttcgcaggcggataaacaagtcaagagtaaaaggcatgggcttaacccatgtaagctattgaaactgtctatcttgagatgtggagaggtaagtggaattactagtgtagcggtgaaatgcgtagatattagtaggaataccagtagcgaaggcgacttactggacacaaactgacgctgaggaacgaaagcgtgggtagcaaacaggattagataccctggtagtccacgctgtaaacgatgagtgctaggtgtcggcaaaagtcggtgccgcagtaaacgcaataagcactccgcctggggagtacgtgcgcaagcatgaaactcaaaggaattgacggggacccgcacaagcagcggagcatgtggtttaattcgaagcaacgcgaagaaccttaccagggcttgacatataggtgaaaagcttagagataagtaatacccttcggggacagctatacaggtggtgcatggttgtcgtcagctcgtgtcgtgagatgttgggttaagtcccgcaacgagcgcaacccttacctttagttaccagcaagtaaagttggggactctagagggactgccgatgataaatcggaggaaggtggggatgacgtcaaatcatcatgccctatatgccctgggcaacacacgtgctacaatggtcggaacaaagggaagcgaagtcgtgaggcgaagcaaaacccataaaaccgatctcagttcggattgttctctgcaactcgagaacatgaagtcggagttgctagtaatcgcagatcagaatgctgcggtgaatgcgttcccgggtcttgtacacaccgcccgtcacaccatgggagttatcaatacccgaagcctgtgagctaacaataagaagcagcagtcgaaggtagggagaatgactggggtgaagtcgtaacaag

SEQ ID NO: 1455 - DNA, 1473 bp, Peptostreptococcus anaerobius
  modified_base (64)..(64): a, c, t, g, unknown or other
gatgaacgctggcggcgtgcctaacacatgcaagtcgagcgcgtctgatttgatgcttgcattnatgaaagatgagcggcggacgggtgagtaacgcgtgggtaacctgccctatacacatggataacatactgaaaagtttactaatacatgataatatatatttacggcatcgtagatatatcaaagtgttagcggtataggatggacccgcgtctgattagctagttggtgagataactgcccaccaaggcgacgatcagtagccgacctgagagggtgatcggccacattggaactgagacacggtccaaactcctacgggaggcagcagtggggaatattgcacaatgggcgcaagcctgatgcagcaacgccgcgtgaacgatgaaggtcttcggatcgtaaagttctgttgcaggggaagataatgacggtaccctgtgaggaagccccggctaactacgtgccagcagccgcggtaatacgtagggggctagcgttatccggatttactgggcgtaaagggtgcgtaggtggtctttcaagtcggtggttaaaggctacggctcaaccgtagttagcctccgaaactggaagacttgagtgcaggagaggaaagtggaattcccagtgtagcggtgaaatgcgtagatattgggaggaacaccagtagcgaaggcggctttctggactgcaactgacactgaggcacgaaagcgtgggtagcaaacaggattagataccctggtagtccacgctgtaaacgatgagtactaggtgtcgggggttacccccctcggtgccgcagctaacgcattaagtactccgcctggggagtacgcacgcaagtgtgaaactcaaaggaattgacggggacccgcacaagtagcggagcatgtggtttaattcgaagcaacgcgaagaaccttacctaagcttgacatcccttagaccggtgtttaatcacaccttcccttcggggctgaggtgacaggtggtgcatggttgtcgtcagctcgtgtcgtgagatgttgggttaagtcccgcaacgagcgcaacccttgtctttagttgccagcattcagttgggcactctagagagactgccagggataacctggaggaaggtggggatgacgtcaaatcatcatgccccttatgcttagggctacacacgtgctacaatgggtggtacagagggttgccaaaccgtgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagtcggaaacacccgaagccgattatccaaccgcaaggaggaagtcgtcgaaggtggcgtcgataactggggtgaagtcgtaacaaggtagccgtatcggaaggtgc

SEQ ID NO: 1456 - DNA, 1427 bp, Peptostreptococcus micros
gacgaacgctggcggcgtgcttaacacatgcaagtcgaacgtgatttttgtggaaagcccttcggggacggaagcgaaatgaaagtggcgaacgggtgagtaacacgtgagcaacctaccttacacagggggatagccgttggaaacgacgattaataccgcatgagaccacaaagccacatggcttaggggtaaaagatttatcggtgtaagatgggctcgcgtctgattagctagttggaagggtaaaggcctaccaaggcaacgatcagtagccggtctgagaggatgaacggccacattggaactgagacacggtccaaactcctacgggaggcagcagtggggaatattgcacaatggggggaaccctgatgcagcgacgccgcgtgagcgaagaaggttttcgaatcgtaaagctctgtcctatgagaagataatgacggtatcataggaggaagccccggctaaatacgtgccagcagccgcggtaatacgtatggggcgagcgttgtccggaattattgggcgtaaagggtacgtaggcggcctattaagtcaggtgtgaaagcgtgaggcttaacctcattaagcacttgaaactggaaggcttgagtgaaggagaggaaagtggaattcctagtgtagcggtgaaatgcgtagatattaggaggaataccggtggcgaaggcgactttctggacttttactgacgctcaggtacgaaagcgtggggagcaacaggattacgataccctggtagtccacgccgtaaacgatgaatgctaggtgttgggagtcaaatctcggtgccgaagttaacacattaagcattccgcctggggagtacggtggcaacactgaaactcaaaggaattgacggggacccgcacaagcagcggagcatgtggtttaattcgaagcaacgcgaagaaccttaccaaggcttgacatatagttgagttattgagaaattgataagtccctcgggacaactatacaggtggtgcatggttgtcgtcagctcgtgtcgtgagatgttgggttaagtcccgcaacgagcgcaacccttatcttcagttaccagcatgtaatgatggggactctggagagactgccgatgacaaatcggaggaaggtggggatgacgtcaaatcatcatgccctttatgtcttgggctacacacgtgctacaatggttggtacaacgagaagctagacagtgatgttaagcaaaactctaaaaaccaatctcagttcggattgtaggctgcaactcgcctacatgaagtcggagttgctagtaatcgcgaatcagaatgtcgcggtgaatgcgttcccgggtcttgtacacaccgcccgtcacaccatgggagttggcaatacccgaagccgccgatctaaccgcaaggaggaaggcgtcgaag

SEQ ID NO: 1457 - DNA, 1353 bp, Peptostreptococcus sp.
  9succ1
  modified_base (91)..(91): a, c, t, g, unknown or other
aaatggattagcggcggacgggtgagtaacacgtgagtaacctgcctttgacatggggatagcctcgggaaaccgggattaatacccaatnaaactgtaagatcgcatgatcaatcagtcaaaatgtctagtggtcaaagatggactcgcgtcccattagctagttggtgagataaaagctcaccaaggcgacgatgggtagccggcctgagagggtgaacggccacattggaactgagacacggtccaaactcctacgggaggcagcagtggggaatattgcacaatgggggaaaccctgatgcagcgacgccgcgtgagcgaagaaggctttcgagtcgtaaagctctgtcctatgggaagatagtgacggtaccataggaggaagccccggctaactacgtgccagcagccgcggtaatacgtagggggctagcgttgtccggaattactgggcgtaaagggttcgcaggcggcaatgcaagtcaggtgtgaaagacggaggctcaacctccgcaagcatttgaaactgcatagcttgagatgtggagaggtaagtggaattcctagtgtagcggtgaaatgcgtagatattaggaggaataccggtggcgaaggcgacttactggacacaaactgacgctgaggaacgaaagcgtggggagcaaacaggattagataccctggtagtccacgctgtaaacgatgagtgctaggtgtcggagcaattcggtgccgtagttaacacaataagcactccgcctggggagtacgtacgcaagtatgaaactcaaaggaattgacggggacccgcacaagcagcggagcatgtggtttaattcgaagcaacgcgaagaaccttaccaggtcttgacatatagtgggatattctagagatagaatagactcttcggagactgctaaacaggtggtgcatggttgtcgtcagctcgtgtcgtgagatgttgggttaagtcccgcaacgagcgcaacccttacctttagttgccagcatgtaaagatggggactctagagggactgccgatgataaatcggaggaaggtggggatgacgtcaaatcatcatgccctatatgacctgggctacacacgtgctacaatggtcggtataaagagaagcaagatagtgatattaagcaaacctcaaaaagccgatctcagttcggattgtaggctgcaactcgcctacatgaagtcggagttgctagtaatcgcagatcagaatgctgcggtgaatgcgttcccgggtcttgtacacaccgcccgtcacaccatgggagttggcaatacccgaagccggtgacctaaccgcaaggaaggagccgtcgaagg

SEQ ID NO: 1458 - DNA, 1327 bp, Peptostreptococcus sp.
  P4P_31 P3
gacgaacgctggcggcgtgcttaacacatgcaagtcgaacgagtggcgaacgggtgagtaacacgtgagcaacctaccttacacagggggatagccgttggaaacgacgattaataccgcatgagcaaagtcggtgtaagatgggctcgcgtctgattagctagttggaagggtaaaggcctaccaaggcaacgatcagtagccggtctgagaggatgaacggccacattggaactgagacacggtccaaactcctacgggaggcagcagtggggaatattgcacaatggggggaaccctgatgcagcgacgccgcgtgagcgaagaaggttttcgaatcgtaaagctctgtcctatgagaagatgacggtatcataggaggaagccccggctaaatacgtgccagcagccgcggtaatacgtatggggcgagcgttgtccggaattattgggcgtaaagggtacgtaggcggccttttaagtcaggtgtgaaagcgtgaggcttaacctcattaagcacttgaaactggaaggcttgagtgaaggagaggaaagtggaattcctagtgtagcggtgaaatgcgtagatattaggaggaataccggtggcgaaggcgactttctggacttactgacgctcaggtacgaaagcgtggggagcaaacaggattagataccctggtagtccacgccgtaaacgatgaatgctaggtgttgggatctcggtgccgaagttaacacattaagcattccgcctggggagtacggtggcaacactgaaactcaaaggaattgacggggacccgcacaagcagcggagcatgtggtttaattcgaagcaacgcgaagaaccttaccaaggcttgacatatacaggtggtgcatggttgtcgtcagctcgtgtcgtgagatgttgggttaagtcccgcaacgagcgcaacccttatcttcagttaccagcatatggggactctggagagactgccgatgataaatcggaggaaggtggggatgacgtcaaatcatcatgccctttatgtcttgggctacacacgtgctacaatggttggcaacgagaagcaagatagtgatgtcaagcaaaactctaccaatctcagttcggatgtaggctgcaactcgcctacagaagtcggagttgctagtaatcgcaaatcagaatgttgcggtgaatgcgttcccgggtcttgtacacaccgcccgtcacaccatgggagttggcaatacccgaagccgccatctaggaaggcgtcgaaggtagggttaatgactggggtgaagtcgtaacaaggtagccgtatcggaaggt

SEQ ID NO: 1459 - DNA, 1333 bp, Peptostreptococcus sp.
  oral clone AP24
gagtttgatcctggctcaggatgaacgttggcgacgtgcctaacacatgcaagtcgagcgagcggcggacgggtgagtaatacatgagcaacctgccttggacagagggatagccgtgggaaaccgcgattaatacctcataagcaaagtcggtccaagatggactcatgacccattagctagttggtgagataacagcccaccaaggcgacgatgggtagccggcttgagagagtgaccggccacattggaactgagacacggtccagactcctacgggaggcagcagtggggaatattgcacaatggaggaaactctgatgcagcgacgtcgcgtgagcgaagaaggttttcgaatcgtaaagctctgtcctatgggaagaagacggtaccatagaagaaagccccggctaactacgtgccagcagccgcggtaatacgtagggggcgaacgttatccggaatgattgggcgtaaagggtacgtaggcggacctgtaagtcaggtgtgaaaggcatgggctcaacccatgtaagcacttgaaactgcgggccttgagggaaggagaggtaagtggaattcctagtgtagcggtgaaatgcgtagatattaggaggaataccggtggcgaaggcgacttactggacttactgacgctgaggtacgaaagcgtggggagcaaacaggattagataccctggtagtccacgccgtaaatggtgagtgctaggtgtcgggatctcggtgccgacgttaacacattaagcactccgcctggggagtacgcacgcaagtgtgaaactcaaaggaattgacggggacccgcacaagcagcggagcatgtggtttaattcgatgcaacgcgaaaaaccttaccaggacttgacatatacaggtggtgcatggttgtcgtcagctcgtgtcgtgagatgttgggttaagtcccgcaacgagcgcaacccctattcttagttactaacagctgaggactctaaggagactgccggtgacaaaccggaggaagatggggatgacgtcaaatcatcatgccctttatgtcctgggctacacacgtgctacaatggtcggcagaaggaagcgagatagcgatatcgagcgaacccccccgatcccagttcggatgttctctgcaactcgagaacagaagccggagttgctagtaattgcgaatcagcatgtcgcagtgaatgcgttcccgggtcttgtacacaccgcccgtcacaccatgggagttggtaatacccgaagcctgtagccaagcagcagtcgaaggtaggatcaatgactggggtgaagtcgtaacaaggtaacc

SEQ ID NO: 1460 - DNA, 1334 bp, Peptostreptococcus sp.
  oral clone FJ023
cggcgcgtcttaagcatgcaagtcgaacgagtggcgaacgggtgagtaacacgtgagcaacctaccttacacagggggatagccgttgaaaacgacgattaataccgcatgagaaaagtcggtgtaagatgggctcgcgtctgattagctagttggaagggtaaaggcctaccaaggcaacgatcagtagccggtctgagaggatgaacggccacattggaactgagacacggtccaaactcctaagggaggcagcagtggggaatattgcacaatggggggaaccctgatgcagcgacgccgcgtgagcgaagaaggttttcgaatcgtaaagctctgtcctatgagaagatgacggtatcataggaggaagccccggctaaatacgtgccagcagccgcggtaatacgtatggggcgagcgttgtccggaattattgggcgtaaagggtacgtaggcggcctattaagtcaggtgtgaaagcgtgaggcttaacctcattaagcacttgaaactggaaggcttgagtgaaggagaggaaagtggaattcctagtgtagcggtgaaatgcgtagatattaggaggaataccggtggcgaaggcgactttctggacttactgacgctcaggtacgaaagcgtggggagcaaacaggattagataccctggtagtccacgccgtaaacgatgagtgctaggtgttgggatctcggcgccgaagttaacacattaagcattccgcctggggagtacggtggcaacactgaaactcaaaggaattgacggggacccgcacaagcagcagagcatgtggtttaattcgaagcaacgcgaagaaccttaccaaggcttgacatatacaggtggtgcatggttgtcgtcagctcgtgtcgtgagatgttgggttaagtcccgcaacgagcgcaacccttatcttcagttaccagcacgtggggactctggagagactgccgatgacaaatcggaagaaggtggggatgacatcaaatcatcatgccctttatgtcttgggctacacacgtgctacaatggttggcaacgagagactagacagtgatgttaagcaaaactctaccaatctcagttcggatgtaggctgcaactcgcctacagaagtcggagttgctagtaatcgcgaatcagaatgtcgcggtgaacgcgttcccgggtcttgtacacaccgcccgtcacaccatgggagttggcaatacccgaagccgccatctaggaaggcgtcgaaggtagggttaatgactggggtgaagtcgtaacaaggtagccgtatcggaaggtgcggttggatcacctcctt

SEQ ID NO: 1461 - DNA, 1432 bp, Peptostreptococcus stomatis
ctgagcaaaaccaagcggcggacgggtgagtaacgcgtgggtaacctgccctatacacatggataacatactgaaaagtttactaatacatgataatatatatttgcggcatcgcagatatatcaaagtgttagcggtataggatggacccgcgtctgattagctagttggtgagataactgcccaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaacgatgaaggtcttcggatcgtaaagttctgttgcaggggaagataatgacggtaccctgtgaggaagccccggctaactacgtgccagcagccgcggtaatacgtagggggctagcgttatccggatttactgggcgtaaagggtgcgtaggtggtccttcaagtcggtggttaaaggctacggctcaaccgtagtaagccgccgaaactggaggacttgagtgcaggagaggaaagtggaattcccagtgtagcggtgaaatgcgtagatattgggaggaacaccagtagcgaaggcggctttctggactgcaactgacactgaggcacgaaagcgtgggtagcaaacaggattagataccctggtagtccacgctgtaaacgatgagtactaggtgtcgggggttacccccctcggtgccgcagctaacgcattaagtactccgcctggggagtacgcacgcaagtgtgaaactcaaaggaattgacggggacccgcacaagtagcggagcatgtggtttaattcgaagcaacgcgaagaaccttacctaagcttgacatccctcggacaggtgtttaatcacacccttccttcgggactgaggtgacaggtggtgcatggttgtcgtcagctcgtgtcgtgagatgttgggttaagtcccgcaacgagcgcaacccttgtctttagttgccagcattcagttgggcactctagagagactgccagggataacctggaggaaggtggggatgacgtcaaatcatcatgccccttatgcttagggctacacacgtgctacaatgggtggtacagagggttgccaaaccgtgaggtggagccaatcccttaaagccattctcagttcggattgtaggctgaaactcgcctacatgaagctggagttactagtaatcgcagatcagaatgctgcggtgaatgcgttcccgggtcttgtacacaccgcccgtcacaccacgggagtcggaaacacccgaagccgattatccaaccgcaaggaggaagtcgtcgaaggtggcgtcgataactggggtgaagtcgtaacaaggtagccgtatcggaaggtgcggctggatcacctcctttct

SEQ ID NO: 1462 - DNA, 1511 bp, Phascolarctobacterium faecium
  modified_base (50)..(50): a, c, t, g, unknown or other
  modified_base (1382)..(1382): a, c, t, g, unknown or other
  modified_base (1477)..(1477): a, c, t, g, unknown or other
atcctggctcaggacgaacgctggcggcgtgcctaacacatgcaagtcgnacggagaattttatttcggtagaattcttagtggcgaacgggtgagtaacgcgtaggcaacctaccctttagacggggacaacattccgaaaggagtgctaataccggatgtgatcatcgtgccgcatggcaggatgaagaaagatggcctctacaagtaagctatcgctaaaggatgggcctgcgtctgattagctagttggtagtgtaacggactaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggatttcggtctgtaaagctctgttgtttatgacgaacgtgcagtgtgtgaacaatgcattgcaatgacggtagtaaacgaggaagccacggctaactacgtgccagcagccgcggtaatacgtaggtggcgagcgttgtccggaattattgggcgtaaagagcatgtaggcggcttaataagtcgagcgtgaaaatgcggggctcaaccccgtatggcgctggaaactgttaggcttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaaggcttgacattgattgaacgctctagagatagagatttcccttcggggacaagaaaacaggtggtgcatggctgtcgtcagctcgtgtcgtgagatgttgggttaagtcccgcaacgagcgcaacccctatcctatgttaccagcaagtaaagttggggactcatgggagactgccagggacaacctggaggaaggcggggatgacgtcaagtcatcatgccccttatgtcttgggctacacacgtactacaatggtcggaaacagagggaagcgaagccgcgaggcagagcaaaccccagaaacccgatctcagttcggatcgcaggctgcaacccgcctgcgtgaagtcggaatcgctagtaatcgcaggtcagcatactgcggtgaatacgtncccgggccttgtacacaccgcccgtcacaccacgaaagttggtaacacccgaagccggtgaggtaacctattaggagccagccgtctaaggtggngccgatgattggggtgaagtcgtaacaaggtagc

SEQ ID NO: 1463 - DNA, 1449 bp, Phascolarctobacterium sp.
  YIT 12068
ttcttagtggcgaacgggtgagtaacgcgtgggcaacctgccctctagatggggacaacatcccgaaaggggtgctaataccgaatgtgacagcaatctcgcatgaggatgctgtgaaagatggcctctatttataagctatcgctagaggatgggcctgcgtctgattagctagttggtggggtaacggcctaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaagctcttttgtttatgacgaatgtgcagattgtgaataatgatctgtaatgacggtagtaaacgaataagccacggctaactacgtgccagcagccgcggtaatacgtaggtggcgagcgttgtccggaattattgggcgtaaagagcatgtaggcggttttttaagtctggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgaatgaccgctccagagatggagctttcccttcggggacatgaaaacaggtggtgcatggctgtcgtcagctcgtgtcgtgagatgttgggttaagtcccgcaacgagcgcaacccctatcctatgttaccagcgggtaatgccggggactcataggagactgccaaggacaacttggaggaaggcggggatgacgtcaagtcatcatgccccttatgtcttgggctacacacgtactacaatggtcggcaacagagggaagcaaagccgtgaggcagagcaaaccccagaaacccgatcccagttcggattgcaggctgcaactcgcctgcatgaagtcggaatcgctagtaatcgcaggtcagcatactgcggtgaatacgttcccgggccttgtacacaccgcccgtcacaccacgaaagttggtaacacccgaagccggtggggtaaccgtaaggagccagccgtctaaggtggggccgatgattggggtgaagtcgtaacaaggtagccgtatcggaaggt

SEQ ID NO: 1464 - DNA, 1610 bp, Phascolarctobacterium succinatutens
gacgaacgctggcggcatgcctaacacatgcaagtcgaacggagaaagttcaacaccaagtatttcatccgctgaagtgtagcggtaaaaattgcgaagcaatttttactacgcattaaaagcatgaactaacacggtggttgaagtattaggtgttgaactttcttagtggcgaacgggtgagtaacgcgtgggcaacctgccctctagatggggacaacatcccgaaaggggtgctaataccgaatgtgacagcaatctcgcatgaggatgctgtgaaagatggcctctatttataagctatcgctagaggatgggcctgcgtctgattagctagttggtggggtaacggcctaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaagctcttttgtttatgacgaatgtgcagattgtaaataatgatctgtaatgacggtagtaaacgaataagccacggctaactacgtgccagcagccgcggtaatacgtaggtggcgagcgttgtccggaattattgggcgtaaagagcatgtaggcggttttttaagtctggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgaatgaccgctccagagatggagctttcccttcggggacatgaaaacaggtggtgcatggctgtcgtcagctcgtgtcgtgagatgttgggttaagtcccgcaacgagcgcaacccctatcctatgttaccagcgggtaatgccggggactcataggagactgccaaggacaacttggaggaaggcggggatgacgtcaagtcatcatgccccttatgtcttgggctacacacgtactacaatggtcggcaacagagggaagcaaagccgtgaggcagagcaaaccccagaaacccgatcccagttcggattgcaggctgcaactcgcctgcatgaagtcggaatcgctagtaatcgcaggtcagcatactgcggtgaatacgttcccgggccttgtacacaccgcccgtcacaccacgaaagttggtaacacccgaagccggtggggtaaccgtaaggagccagccgtctaaggtggggccgatgattggggtgaagtcgtaacaaggtagccgtatcggaagg

SEQ ID NO: 1465 - DNA, 1276 bp, Phenylobacterium zucineum
ctggcggcaggcctaatacatgcaagtcgagcgagcggcggacgggtgagtaacgcgtgggaatgtgccctttggtacggaacaacacagggaaacttgtgctaataccgtatgtggaaagtcgccattggagcagcccgcgttggattaggtagttggtgaggtaaaggctcaccaagccgacgatccatagctggtctgagaggatgatcagccacactgggactgagacacggcccagactcctacgggaggcagcagtagggaatcttgcgcaatgggcgaaagcctgacgcagccatgccgcgtgaatgatgaaggtcttaggattgtaaaattctttcaccggggaagatgacggtacccggagaagaagtcccggctaacttcgtgccagcagccgcggtaatacgaagggggctagcgttgctcggaattactgggcgtaaagggcgcgtaggcggatgtttaagtcgggggtgaaagcccggggctcaacctcggaattgccttcgatactggacatcttgagtacgggagaggtgagtggaactccgagtgtagaggtgaaattcgtagatattcggaagaacaccagtggcgaaggcgactcactggcccgactgacgctgaggcgcgaaagcgtggggagcaaacaggattagataccctggtagtccacgccgtaaacgatgagtgctagttgtcggcatgtcggtgacgcagctaacgcattaagcactccgcctggggagtacggtcgcaagattaaaactcaagggaattgacgggggcccgcacaagcggtggagcatgtggtttaattcgaagcaacgcgcagaaccttaccaccttttgacatgcacaggtgctgcatggctgtcgtcagctcgtgtcgtgagatgttgggttaagtcccgcaacgagcgcaaccctcgccattagttgccatcatgggcactctaatgggaccgccggtggtaagccggaggaaggtggggatgacgtcaagtcctcatggcccttacggggtgggctacacacgtgctacaatggcgaccagagggttgcgatgctgcgaagcggagctaatccctgtcgtctcagttcggatgcactctgcaactcgagtgcagaagtcggaatcgctagtaatcgcggatcagcatgccgcggtgaatacgttcccgggccttgtacacaccgcccgtcgcaccatgggagttggctttacccgaaggcggtcgctaggcagccgaccacggtagggtcagcg

SEQ ID NO: 1466 - DNA, 1428 bp, Photorhabdus asymbiotica
acatgcaagtcgagcggtaacaggaaagtgcttgcacttttgctgacgagcggcggacgggtgagtaatgtctggggatctgcccgagggcgggggataaccactggaaacggtggctaataccgcatgatgtcgcgagaccaaagtgggggacctgaaagggcctcacgccctcggatgaacccagatgggattagctagtaggtagggtaatggcctacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagcaggccttcgggttgtaaagtactttcagcggggaggaagggtttggcctgaagagggttaaattttgacgttacccgcagaagaagcaccggctaactccgtgccagcagccgcggtaatacggagggtgcaagcgttaatcggaatgactgggcgtaaagcgcacgcaggcggtcaattaagttagatgtgaaatccccgggctcaacctgggaatggcatctaagactggttggctagagtctcgtagaggggggtagaattccatgtgtagcggtgaaatgcgtagagatgtggaggaataccggtggcgaaggcggccccctggacgaagactgacgctcatgtgcgaaagcgtggggagcaaacaggattagataccctggtagtccacgctgtaaacgatgtcgatttggaggttgtggcctagagctgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaagacctcagagatgaggttgtgccttcgggagctctgagacaggtgctgcatggctgtcgtcagctcgtgttgtgaaatgttgggttaagtcccgcaacgagcgcaacccttatcctttgttgccagcacgttgaggtgggaactcaaaggagactgccggtgataaaccggaggaaggtggggatgacgtcaagtcatcatggccctgacgagtagggctacacacgtgctacaatggcggatacaaagtgaagcgacctcgcgagagcaagcggaacacacaaagtctgtcgtagtccggattggagtctgcaactcgactccatgaagtcggaatcgctagtaatcgtagatcagcatgctacggtgaatacgttcccgggccttgtacacaccgcccgtcacaccatgggagtgggtggcaaaagaagtcggtagcctaaccgcgaggggggcgctgaccactttgtgat

SEQ ID NO: 1467 - DNA, 1501 bp, Pigmentiphaga daeguensis
ctggctcagattgaacgctagcggcatgccttacacatgcaagtcgaacggcagcgcggacttcggtctggcggcgagtggcgaacgggtgagtaatgcatcggaacgtacccagtagcgggggataactacgcgaaagcgtagctaataccgcatacgccctacgggggaaagggggggatcgcaagacctctcactattggagcggccgatgtcggattagctagttggtggggtaaaggcctaccaaggcgacgatccgtagctggtttgagaggacgaccagccacactgggactgagacacggcccagactcctacgggaggcagcagtggggaattttggacaatgggggcaaccctgatccagccatgccgcgtgtgcgaagaaggccttcgggttgtaaagcacttttggcgggaaagaaacggcgccggctaatacctggcgtaactgacggtacccgcagaataagcaccggctaactacgtgccagcagccgcggtaatacgtagggtgcaagcgttaatcggaattactgggcgtaaagcgtgcgcaggcggttcggaaagaaagatgtgaaatcccagggctcaaccttggaactgcatttttaactcccgaactagagtgtgtcagagggaggtggaattccacgtgtagcagtgaaatgcgtagatatgtggaggaacaccgatggcgaaggcagcctcctgggataacactgacgctcatgcacgaaagcgtggggagcaaacaggattagataccctggtagtccacgccctaaacgatgtcaactagctgttgggttcttcggagcttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcccgaagagatttgggagtgctcgaaagagaaccggaacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcctcatggcccttatgggtagggcttcacacgtcatacaatggtcgggacagagggctgccaacccgcgagggggagccaatcccagaaacccgatcgtagtccggattgcagtctgcaactcgactgcatgaagtcggaatcgctagtaatcgcggatcagcatgtcgcggtgaatacgttcccgggtcttgtacacaccgcccgtcacaccatgggagtgggttctaccagaagtaggtagcctaaccgcaaggagggcgcttaccacggtagggttcatgactggggtgaagtcgtaacaaggtagccgtatcggaaggtgcggctgg

SEQ ID NO: 1468 - DNA, 1506 bp, Planomicrobium koreense
gacgaacgctggcggcatgcctaatacatgcaagtcgagcggaacgttgggagcttgctcccttcgtttagcggcggacgggtgagtaacacgtgggcaacctgccctgcagatcgggataactccgggaaaccggtgctaataccgaatagttttttgcccctcctggggcggaacggaaagacggtttcggctgtcactgcaggatgggcccgcggcgcattagctagttggtggggtaacggcccaccaaggcgacgatgcgtagccgacctgagagggtgatcggccacactgggactgagacacggcccagactcctacgggaggcagcagtagggaatcttccgcaatggacgaaagtctgacggagcaatgccgcgtgagtgacgaaggttttcggatcgtaaaactctgttgtaagggaagaacaagtaccaagtaactactggtaccttgacggtaccttaccagaaagccacggctaactacgtgccagcagccgcggtaatacgtaggtggcaagcgttgtccggaattattgggcgtaaagcgcgcgcaggcggtcccttaagtctgatgtgaaagcccacggctcaaccgtggagggtcattggaaactgggggacttgagtgcagaagaggaaagtggaattccatgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgcctaggagactaggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggctgcaaacccgcgagggggagccaatcccagaaaaccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaaccacttgtggagccagccgccgaaggtgggacagatgattggggtgaagtcgtaacaaggtagccgtatcggaaggtgc

SEQ ID NO: 1469 - DNA, 1499 bp, Plesiomonas shigelloides
gagtttgatcatggctcagattgaacgctggcggcaggcctaacacatgcaagtcgagcggtaacacagaggagcttgctccttgggtgacgagcggcggacgggtgagtaatgcctggggatctgcccgatagagggggataactacgggaaactgtagctaataccgcataatgtctacggaccaaagtgggggctttcggacctcatgctatcggatgaacccaggtgggattagctagttggtgaggtaatggctcaccaaggcgacgatctctaactggtttgagagaatgaccagtcacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaagggtcactagttaatacctagtggcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagctcaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccacagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcatatacaaagggcggcaagctagcgatagtgagcgaatcccataaagtatgtcgtagtccggattggagtctgcaactcgactccatgaagtcggaatcgctagtaatcgcggatcagaatgccgcggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaa

SEQ ID NO: 1470 - DNA, 1296 bp, Porphyromonadaceae bacterium NML 060648
caggcttaacacatgcaagtcgagggaccggcgcacgggtgagtaacgcgtatgcaacctacctatcagaggggaataacccggcgaaagtcggactaataccgcataaataaagtcgctgatagatgggcatgcgttccattaggtagttggtgaggtaacggctcaccaagccgacgatggataggggaactgagaggttggtcccccacactggtactgagacacggaccagactcctacgggaggcagcagtgaggaatattggtcaatgggcgggagcctgaaccagccaagtcgcgtgaaggaagaaggattatggttcgtaaacttcttttgcaggggaatatgtatgtaccctgagaataaggatcggctaactccgtgccagcagccgcggtaatacggaggatccgagcgttatccggatttattgggtttaaagggtgcgtaggtggtttgataagtcagcggtgaaagtttgcagcttaactgtaaaaatgccgttgaaactgtcggacttgagtgtaaatgaggtaggcggaatgcgtggtgtagcggtgaaatgcatagatatcacgcagaactccgattgcgaaggcagcttactaagctaactgacactgaagcacgaaagcgtggggatcaaacaggattagataccctggtagtccacgcagtaaacgatgattactagctgtttgcgagtaagcggcacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgtacgaggtgctgcatggttgtcgtcagctcgtgccgtgaggtgtcggcttaagtgccataacgagcgcaacccttatttycagttactaacagctgaggactctggagagactgccagcgtaagctggaggaaggtggggatgacgtcaaatcagcacggcccttacatccggggcgacacacgtgttacaatggtaagcaaagggcagctaccgggcgaccggatgcgaatctctcttatctcagttcggacggagtctgcaactcgactccggaagctggattcgctagtaatcgcgcatcagccatggcgcggtgaatacgttcccgggccttgtacacaccgcccgtcaagccatgggagccgggggtacctgaagttcgtatcgacctagggtaaaactggtgactggggctaagtcgtaacaaggtagccgtac

SEQ ID NO: 1471 - DNA, 1531 bp, Porphyromonas asaccharolytica
acaatggagagtttgactctggctcaggatgaacgctagcgataggcttaacacatgcaagtcgaggggcagcgagatgtagcaatacgtcgtcggcgaccggcgaatgggtgagtaacacgtatgcaacttacctcttagtggtgaataacccgatgaaagtcggactaatacaccatatactccttagatcccatgagaagaggaggaaagattaatcgctaagagatgggcctgcgttccattagctagttggtaaggtaacggcttaccaaggcaacgatggatagggggactgagaggttgaccccccacattgacactgagatacgggtcaaactcctacgggaggcagcagtgaggaatattggtcaatgggcgagagcctgaaccagccaagtcgcgtgaaggaagactgcccgcaagggttgtaaacttcttttgtatgggattaaagtcacctacgtgtaggtgtttgcagttaccatacgaataagcatcggctaactccgtgccagcagccgcggtaatacggaggatgcgagcgttatccggaattattgggtttaaagggtgcgtaggttgcaagggaagtcaggggtgaaaagctgtagctcaactatggtcttgcctttgaaactctctagctagagtgtactggaggtacgtggaacgtgtggtgtagcggtgaaatgcatagatatcacacagaactccgattgcgcaggcagcgtactacattacaactgacactgaagcacgaaagcgtgggtatccaacaggattagataccctggtagtccacgcagtaaacgatgaatactagatctatgcgatatacagtatgggtctaagcgaaagcgataagtattccacctggggagtacgccggcaacggtgaaactcaaagagattggcgggggtccgcacaagcggaggaacatgtggtttaattcgatgatacgcgaggaaccttacccgggattgaaatgtagatgcatgaggctgagaggtctcttcccttcggggcttctatgtaggtgctgcatggttgtcgtcagctcgtgccgtgaggtgtcggcttaagtgccataacgagcgcaacccgcgtcgatagttactaacgagtcaagtcgaggactctatcgagacagccgtcgtaagacgtgaggaaggagcggatgacgtcaaatcagcacggcccttacatccggggcgacacacgtgttacaatggtagggacagcgagcagccatctggtgacagagagctaatctataaaccctatcccagttcggatcggagtctgcaactcgactctgtgaagctggattcgctagtaatcgcgcatcagccatggcgcggtgaatacgttcccggaccttgcacacaccgcccgtcaagccatgggagtcgggggtacctgaagagcgtgaccgtcacaggagcgcttgagggtaaaactggtgactggggctaagtcgtaacaaggtagccgtaccggaaggtgcggctggaacacctcctttct

SEQ ID NO: 1472 - DNA, 1533 bp, Porphyromonas endodontalis
acaatggagagtttgatcctggctcaggatgaacgctagcgataggcttaacacatgcaagtcgaggggcagcattattttagcttgctaagatagatggcgaccggcgcacgggtgcgtaacgcgtatgcaacctgcctgtaattagggaataacccggtgaaagtcggactaataccctatattcttctttctccgcatggaggaggacggaaagatttattgattacagatgggcatgcgtcccattagctggttggtaaggtaacggcttaccaaggcaacgatgggtagggggactgagaggttgaccccccacactggtactgagacacggaccagactcctacgggaggcagcagtgaggaatattggtcaatgggcgagagcctgaaccagccaagtcgcgtgaaggacgacggttctatggattgtaaacttcttttgtagaggaataatggcagctacgtgtagctgagatgcatgtactctacgaataagtatcggctaactccgtgccagcagccgcggtaatacggaggatacgagcgttatccggaattattgggtttaaagggtgcgtaggtggcgtattaagtcagtggtgaaaagctgcagctcaactgtagtcttgccgttgaaactgatatgctagagaggagacgaggtatgcggaatgtgtggtgtagcggtgaaatgcatagatatcacacagaacgccgattgcgaaggcagcgtaccaggctccgtctgacactgaagcacgaaagcgtggggatcaaacaggattagataccctggtagtccacgcagtaaacgatgaatactagatttttgcgatatactgtaagagtctaagcgaaagcgataagtattccacctggggagtacgccggcaacggtgaaactcaaaggaattgacgggggcccgcacaagcggaggaacatgtggtttaattcgatgatacgcgaggaaccttacccgggattgaaatttagatgatggcagatgagagtttgctttccttcgggacatctaagtaggtgctgcatggttgtcgtcagctcgtgccgtgaggtgtcggcttaagtgccataacgagcgcaacccgcgtcgatagttactaacaggttatgctgaggactctatcgagacagccgtcgtaagacgcgaggaaggggcggatgacgtcaaatcagcacggcccttacatccggggcgacacacgtgttacaatggcagggacaaagggaagcgacatggtgacatgaagcggatctccaaaccctgtcccagttcggatcggagtctgcaactcgactccgtgaagctggattcgctagtaatcgcgcatcagccatggcgcggtgaatacgttcccgggccttgtacacaccgcccgtcaagccatggaagttgggagtacctgaagagcgtaaccgcaaggggcgcttaagggtaataccagtgactggggctaagtcgtaacaaggtagccgtaccggaaggtgcggctggaatacctcctttct

SEQ ID NO: 1473 - DNA, 1475 bp, Porphyromonas gingivalis
acagtggagagtttgatcctggctcaggatgaacgctagcgataggcttaacacatgcaagtcgaggggcagcatgatcttagcttgctaaggttgatggcgaccggcgcacgggtgcgtaacgcgtatgcaacttgccttacagagggggataacccgttgaaagacggactaaaaccgcatacacttgtattattgcatgatattacaaggaaatatttatagctgtaagataggcatgcgtcccattagcttgttggtgaggtaacggctcaccaaggcgacgatgggtaggggaactgagaggtttatcccccacactggtactgagacacggaccagactcctacgggaggcagcagtgaggaatattggtcaatgggcgagagcctgaaccagccaagtcgcgtgaaggaagacagtcctaaggattgtaaacttcttttatacgggaataacgggcgatacgagtattgcattgaatgtaccgtaagaataagcatcggctaactccgtgccagcagccgcggtaatacggaggatgcgagcgttatccggatttattgggtttaaagggtgcgtaggttgttcggtaagtcagcggtgaaacctgagcgctcaacgttcagcctgccgttgaaactgccgggcttgagttcagtggcggcaggcggaattcgtggtgtagcggtgaaatgcatagatatcacgaggaactccgattgcgaaggcagcttgccatactgcgactgacactgaagcacgaaggcgtgggtatcaaacaggattagataccctggtagtccacgcagtaaacgatgattactaggagtttgcgatataccgtcaagcttccacagcgaaagcgttaagtaatccacctggggagtacgccggcaacggtgaaactcaaaggaattgacgggggcccgcacaagcggaggaacatgtggtttaattcgatgatacgcgaggaaccttacccgggattgaaatgtagatgacggatggtgaaaaccgtcttcccttcggggcttctatgtaggtgctgcatggttgtcgtcagctcgtgccgtgaggtgtcggcttaagtgccataacgagcgcaacccacatcggtagttactaacagttttcgctgaggactctaccgagactgccgtcgtaaggcgtgaggaaggtgtggatgacgtcaaatcagcacggcccttacatccggggcgacacacgtgttacaatgggagggacaaagggcagctaccgggcgaccggatgcgaatctctaaacccttccccagttcggatcggagtctgcaactcgactccgtgaagctggattcgctagtaatcgcgcatcagccatggcgcggtgaatacgttcccgggccttgtacacaccgcccgtcaagccatgggagtcgggggtacctgaagggcgtaaccgcaaggggcgcactagggtaataccggtgact

SEQ ID NO: 1474 - DNA, 1476 bp, Porphyromonas levii
  modified_base (31)..(31): a, c, t, g, unknown or other
  modified_base (49)..(49): a, c, t, g, unknown or other
  modified_base (341)..(341): a, c, t, g, unknown or other
  modified_base (541)..(541): a, c, t, g, unknown or other
  modified_base (645)..(645): a, c, t, g, unknown or other
  modified_base (811)..(811): a, c, t, g, unknown or other
  modified_base (963)..(963): a, c, t, g, unknown or other
  modified_base (973)..(974): a, c, t, g, unknown or other
  modified_base (1021)..(1023): a, c, t, g, unknown or other
  modified_base (1116)..(1116): a, c, t, g, unknown or other
  modified_base (1293)..(1293): a, c, t, g, unknown or other
  modified_base (1448)..(1448): a, c, t, g, unknown or other
acaatggagagtttgatcctggctcaggatnaacgctagcgataggctnaacacatgcaagtcgaggggtaacatgggagtagcttgctgcttctgatgacgaccggcggatgggtgagtaacgcgtatgcaacttgcctcttagtggggaataacccggagaaatccggactaataccgcatacacttagttatccgcatggatgattaaggaaagatttattgctaagagataggcatgcgttccattagttagttggtgaggtaacggctcaccaaggcatcgatggataggggagctgagaggcttatcccccacattgggactgagacacggcccnaactcctacgggaggcagcagtgaggaatattggtcaatggaggaaactctgaaccagccaagtcgcgtgaaggatgactgtcctatggattgtaaacttctttagtaggcgagtaaacgtaggtacgagtacctacctgcaagtagcctaagaataagtatcggctaactccgtgccagcagccgcggtaatacggagnatacgagcgttatccggatttattgggtttaaagggtgcgtaggtggcagattaagtcagtggtgaaaagctgtggctcaaccatagtcttgccgttgaaactngtttgcttgagtacagttgatgtaggcggaatgcgtagtgtagcggtgaaatgcatagatattacgcagaactccgattgcgaaggcagcttacaaaagtgtaactgacactgatgcacgaaagcgtgggtatcaaacaggattagataccctggtagtccacgcngtaaactatgattactcagagtatgcgatataatgtatgctctcaagcgaaagcattaagtaatccacctggggagtacgtcggcaacgatgaaactcaaaggaattgacgggggcccgcacaagcggaggaacatgtggtttaattcgatnatacgcgagnnaccttacctgggattgaaatgtataggacaggggatggaaacattcnnnttctcttcggagacttatatgtaggtgctgcatggttgtcgtcagctcgtgccgtgaggtgtcggcttaagtgccataacgagcgcaaccctnatcgttagttactagcaggtagtgctgaggactctagcgagactgccgtcgtaagacgagaggaaggtggggatgacgtcaaatcagcacggcccttatatccagggcgacacacgtgttacaatggtgaggacaaagggtagctacctggtgacaggatgccaatctccaaacctnatctcagttcggatcgaagtctgcaactcgacttcgtgaagctggattcgctagtaatcgcgcatcagccatggcgcggtgaatacgttcccgggccttgtacacaccgcccgtcaagccatgggagctgggggtacctgaagtacgtgaccgcnaggagcgtccgagggtaagaccggtgac

SEQ ID NO: 1475 - DNA, 1473 bp, Porphyromonas macacae
  modified_base (31)..(31): a, c, t, g, unknown or other
  modified_base (49)..(49): a, c, t, g, unknown or other
  modified_base (174)..(174): a, c, t, g, unknown or other
  modified_base (392)..(392): a, c, t, g, unknown or other
  modified_base (440)..(440): a, c, t, g, unknown or other
  modified_base (455)..(455): a, c, t, g, unknown or other
  modified_base (475)..(475): a, c, t, g, unknown or other
  modified_base (507)..(507): a, c, t, g, unknown or other
  modified_base (530)..(530): a, c, t, g, unknown or other
  modified_base (544)..(544): a, c, t, g, unknown or other
  modified_base (1318)..(1318): a, c, t, g, unknown or other
  modified_base (1408)..(1408): a, c, t, g, unknown or other
acagagaagagtttgatcctggctcaggatnaacgctagcgataggctnaacacatgcaagtcgaggggcagcatggtcttagcttgctaagattgatggcgaccggcgcacgggtgcgtaacgcgtatgtaacttgcctgatagaaagggataacccggtgaaagtcggactnataccttatggtcttgggttattgcatgatgattcaagtaaagattaattgctatcagataggcatgcgttccattagttggttggtgaggtaacggctcaccaaggctacgatggataggggaatgagaggtttatcccccacactggtactgagacacggaccagactcctacgggaggcagcagtgaggaatattggtcaatgggcgagagcctnaaccagccacgtcgcgtgaaggaagacggttctatggattgtaaactncttttataggggatnaagttatccacgtgtggatntttgcaagtaccctatgaataagcatcggctnactccgtgccagcagccgcggtnatacggaggatgcnagcgttatccggatttattgggtttaaagggtgcgtaggtggcctgataagtcgggggtgaaaagctgtggctcaaccacagtcttgccttcgaaactgtttggcttgagtatagatgaagtaggcggaatttgtggtgtagcggtgaaatgcatagatatcacgaggaactccgattgcgaaggcagcttactaagttatgactgacactgaagcacgaaagcgtgggtatcaaacaggattagataccctggtagtccacgcagtaaacgatgataactgggcgtatgcgatatacagtatgctcctgagcgaaagcgttaagttatccacctggggagtacgccggcaacggtgaaactcaaaggaattgacgggggcccgcacaagcggaggaacatgtggtttaattcgatgatacgcgaggaaccttacccgggattgaaatttagcggactatgtatgaaagtacatatcctgtcacaaggccgctaagtaggtgctgcatggttgtcgtcagctcgtgccgtgaggtgtcggcttaagtgccataacgagcgcaacccacgttgtcagttactatcgggtaaagccgaggactctgacaagactgccgtcgtaaggcgcgaggaaggtgtggatgacgtcaaatcagcacggcccttacatccggggcgacacacgtgttacaatggtggggacaaagggcagctacttggtgacaagatgcgaatctccaaaccccatcccagttcggatcgtagtctgcaactngactatgtgaagctggattcgctagtaatcgcgcatcagccatggcgcggtgaatacgttcccgggccttgtacacaccgcccgtcaagncatgggagtcgggagtacctaaagcacgtaaccgcgaggggcgtgtcagggtaataccggtgact

SEQ ID NO: 1476 - DNA, 1486 bp, Porphyromonas somerae
tggctcaggatgaacgctagcgataggcttaacacatgcaagtcgaggggtaacatggagagaagcttgcttcactctgatgacgaccggcggatgggtgagtaacgcgtatgcaacttgcctcttagtgggggataacccggagaaatccggactaataccgcatattcttaatttctcgcatgagttattaaggaaagatttattgctaagagataggcatgcgttccattagttagttggtgaggtaacggctcaccaaggcatcgatggataggggagctgagaggctgatcccccacattgggactgagacacggcccaaactcctacgggaggcagcagtgaggaatattggtcaatggaggaaactctgaaccagccaagtcgcgtgaaggatgacggtcctatggattgtaaacttctttagtaggtgagtaaggataggtacgtgtacctattagaaagtagcctaagaataagtatcggctaactccgtgccagcagccgcggtaatacggaggatacgagcgttatccggatttattgggtttaaagggtgcgtaggtggctgattaagtcagtggtgaaaagctatggctcaaccatagtcttgccgttgatactggttagcttgagtgtagatgatgtaggcggaatgcgtagtgtagcggtgaaatgcatagatattacgcagaactccgattgcgaaggcagcttacaaaactactactgacactgaggcacgaaagcgtgggtatcaaacaggattagataccctggtagtccacgccgtaaactatgattactcagagtatgcgatatacagtatgctctcaagcgaaagcattaagtaatccacctggggagtacgtcggcaacgatgaaactcaaaggaattgacgggggcccgcacaagcggaggaacatgtggtttaattcgatgatacgcgaggaaccttacctgggattgaaatgtataggctggcaactggaaacagatgctgttcacttcggtgacttatatgtaggtgctgcatggttgtcgtcagctcgtgccgtgaggtgtcggcttaagtgccataacgagcgcaacccttatcgttagttgctaacaggttaagctgaggactctggcgagactgccgtcgtaaggcgagaggaaggtggggatgacgtcaaatcagcacggcccttatatccagggcgacacacgtgttacaatggtgaggacaaagggtagctacctggtgacaggatgccaatctccaaacctcatctcagttcggatcgaagtctgcaactcgacttcgtgaagctggattcgctagtaatcgcgcatcagccatggcgcggtgaatacgttcccgggccttgtacacaccgcccgtcaagccatggaagctgggggtacctgaagtgcgtgaccgcgaggagcgtccgagggtaagaccggtgactggggctaagtcgtaacaaggtaacc

SEQ ID NO: 1477 - DNA, 1482 bp, Porphyromonas sp.
  UQD 301
gctcaggatgaacgctagcgataggcttaacacatgcaagtcgaggggcagcatggtcttagcttgctaagactgatggcgaccggcgcacgggtgcgtaacgcgtatgcaacttgccttacagagggggataacccgttgaaagacggactaacaccgcatatgctcaggggtctgcatgggcctttgaggaaatatttatagctgtaagataggcatgcgtcccattagcttgttggtgaggtaacggctcaccaaggcaacgatgggtaggggaactgagaggtttatcccccacactggtactgagacacggaccagactcctacgggaggcagcagtgaggaatattggtcaatgggcgagagcctgaaccagccaagtcgcgtgaaggatgaaggccctatgggtcgtaaacttcttttatacgggaataacgagccttacgggtagggcgctgaatgtaccgtaggaataagcatcggctaactccgtgccagcagccgcggtaatacggaggatgcgagcgttatccggatttattgggtttaaagggtgcgtaggttgcttggtaagtcagcggtgaaaactgaacgctcaacgttcagcgtgccgttgaaactgtcaggcttgagtgcagtggcggcaggcggaattcgtggtgtagcggtgaaatgcatagatatcacgaggaactccgattgcgaaggcagcttgccatactgtaactgacactgaagcacgaaggcgtgggtatcaaacaggattagataccctggtagtccacgcagtaaacgatgattactaggagtttgcgatataccgataagcttccacagcgaaagcgttaagtaatccacctggggagtacgccggcaacggtgaaactcaaaggaattgacgggggcccgcacaagcggaggaacatgtggtttaattcgatgatacgcgaggaaccttacccgggattgaaatgtagatgacagatggtgaaagccgttcttccttcgggacatctatgtaggtgctgcatggttgtcgtcagctcgtgccgtgaggtgtcggcttaagtgccataacgagcgcaacccacattggtagttactaacaggtcaagctgaggactctaccgagactgccgtcgtaaggcgcgaggaaggtgtggatgacgtcaaatcagcacggcccttacatccggggcgacacacgtgttacaatgggagggacaaagggcagctaccgggcgaccggatgcgaatctcgaaacccttccccagttcggatcggagtctgcaactcgactccgtgaagctggattcgctagtaatcgcgcatcagccatggcgcggtgaatacgttcccgggccttgtacacaccgcccgtcaagccatgggagtcgggggtacctgaaggacgtaaccgcaaggggcgtactagggtaataccggtgactggggctaagtcgtaacaaggtaaccgta

SEQ ID NO: 1478 - DNA, 1509 bp, Porphyromonas sp.
  oral clone BB134
gagagtttgattctggctcaggatgaacgctagcgataggcttaacacatgcaagtcgaggggcagcattattttagcttgctaagatagatggcgaccggcgcacgggtgcgtaacgcgtatgcaacctgcctgtaattagggaataacccggtgaaagtcggactaataccctatattcttctttttccgcatggggaaagacggaaagatttattgattacagatgggcatgcgtcccattagctcgttggtaaggtaacggcttaccaaggcaacgatgggtagggggactgagaggttgaccccccacactggtactgagacacggaccagactcctacgggaggcagcagtgaggaatattggtcaatgggcgagagcctgaaccagccaagtcgcgtgaaggacgacggttctatggattgtaaacttcttttgtagaggaataatggcagctacgcgtagctgagatgcatgtactctacgaataagtatcggctaactccgtgccagcagccgcggtaatacggaggatacgagcgttatccggaattattgggtttaaagggtgcgtaggtggcgtattaagtcagtggtgaaaagctgcagctcaactgtagtcttgccgttgaaactgatatgctagagaggagacgaggtatgcggaatgtgtggtgtagcggtgaaatgcatagatatcacacagaacgccgattgcgaaggcagcgtaccaggctccgtctgacactgaagcacgaaagcgtggggatcaaacaggattagataccctggtagtccacgcagtaaacgatgaatactagatttttgcgatatagtgtaagagtctaagcgaaagcgataagtattccacctggggagtacgccggcaacggtgaaactcaaaggaattgacgggggcccgcacaagcggaggaacatgtggtttaattcgatgatacgcgaggaaccttacccgggattgaaatttagatggtggcagatgagagtttgctttccttcgggacatctaagtaggtgctgcatggttgtcgtcagctcgtgccgtgaggtgtcggcttaagtgccataacgagcgcaacccgcgtcgatagttactaacaggttaagctgaggactctatcgagacagccgtcgtaagacgtgaggaaggggcggatgacgtcaaatcagcacggcccttacatccggggcgacacacgtgttacaatggcagggacaaagggaagcgacatggtgacatgaagcggatctccaaaccctgtcccagttcggatcggagtctgcaactcgactccgtgaagctggattcgctagtaatcgcgcatcagccatggcgcggtgaatacgttcccgggccttgtacacaccgcccgtcaagccatggaagttgggagtacctgaagagcgtaaccggaaggggcgcttaagggtaataccagtgactggggctaagtcgtaacaaggtagccgtaccggaaggtgcgg

SEQ ID NO: 1479 - DNA, 1465 bp, Porphyromonas sp.
  oral clone F016
  modified_base (629)..(629): a, c, t, g, unknown or other
cctggctcaggatgaacgctagcgataggcttaacacatgcaagtcgaggggcagcattattttagcttgctaagatagatggcgaccggcgcacgggtgcgtaacgcgtatgcaacctgcctgtaattagggaataacccggtgaaagtcggactaataccctatattcatcgttaaccgcatggttggtgatggaaagatttattgattacagatgggcatgcgtcccattagctagttggtaaggtaacggcttaccaaggcaacgatgggtagggggactgagaggttgaccccccacactggtactgagacacggaccagactcctacgggaggcagcagtgaggaatattggtcaatgggcggaagcctgaaccagccaagtcgcgtgaaggaagacggttctatggattgtaaacttcttttgtagaggaataatggcagctacgtgtagctgagatgcatgtactctacgaataagtatcggctaactccgtgccagcagccgcggtaatacggaggatacgagcgttatccggaattattgggtttaaagggtgcgtaggtggcgtattaagtcagtggtgaaaagctgcagctcaactgtagtcttgccgttgaaactnatatgctagagaggagacgaggtatgcggaatgtgtggtgtagcggtgaaatgcatagatatcacacagaacgccgattgcgaaggcagcgtaccaggctccgtctgacactgaagcacgaaagcgtggggatcaaacaggattagataccctggtagtccacgcagtaaacgatgaatactagatttttgcgatatacagtaagagtctaagcgaaagcgataagtattccacctggggagtacgccggcaacggtgaaactcaaaggaattgacgggggcccgcacaagcggaggaacatgtggtttaattcgatgatacgcgaggaaccttacccgggattgaaatttagatggcggcagatgagagtttgctttccttcgggacatctaagtaagtgctgcatggttgtcgtcagctcgtgccgtgaggtgtcggcttaagtgccataacgagcgcaacccgcgttgatagttactaacaggttaagctgaggactctatcgagacagccgtcgtaagacgagaggaaggggcggatgacgtcaaatcagcacggcccttacatccggggcgacacacgtgttacaatggcagggacaaagggaagcgacatggtgacatgaagcggatctccaaaccctgtcccagttcggatcggagtctgcaactcgactccgtgaagctggattcgctagtaatcgcgcatcagccatggcgcggtgaatacgttcccgggccttgtacacaccgcccgtcaagccatggaagttgggagtacctgaagagcgtaaccgcaaggggcgcttaagggtaataccagtgactggggctaa

SEQ ID NO: 1480 - DNA, 1286 bp, Porphyromonas sp.
  oral clone P2PB_52 P1
  modified_base (1230)..(1230): a, c, t, g, unknown or other
gatgaacgctagcgataggcttaacacatgcaagtcgagggaccggcgcacgggtgcgtaacgcgtatgcaacctgcctgtaattagggaataacccggtgaaagtcggactaataccctatattgaaagttgattacagatgggcatgcgtcccattagctagttggtaaggtaacggcttaccaaggcaacgatgggtagggggactgagaggttgaccccccacactggtactgagacacggaccagactcctacgggaggcagcagtgaggaatattggtcaatgggcgagagcctgaaccagccaagtcgcgtgaaggacgacggtttatggattgtaaacttcttttgtagaggaatatgcatgtactctacgaataagtatcggctaactccgtgccagcagccgcggtaatacggaggatacgagcgttatccggaattattgggtttaaagggtgcgtaggtggcatattaagtcagtggtgaaaagctgcagctcaactgtagtcttgccgttgaaactgatatgctagagaggagacgaggtatgcggaatgtgtggtgtagcggtgaaatgcatagatatcacacagaacgccgattgcgaaggcagcgtaccaggctctctgacactgaagcacgaaagcgtggggatcaaacaggattagataccctggtagtccacgcagtaaacgatgaatactagatttttgcgtgtaagagtctaagcgaaagcgataagtattccacctggggagtacgccggcaacggtgaaactcaaaggaattgacgggggcccgcacaagcggaggaacatgtggtttaattcgatgatacgcgaggaaccttacccgggattgaaattagtaggtgctgcatggttgtcgtcagctcgtgccgtgaggtgtcggcttaagtgccataacgagcgcaacccgcgtcgatagttactaacagctgaggactctatcgagacagccgtcgtaagacggaggaaggggcggatgacgtcaaatcagcacggcccttacatccggggcgacacacgtgttacaatggcaggcaaagggaagcgacatggtgacatgaagcggatctcccctgtcccagttcggacggagtctgcaactcgactccggaagctggattcgctagtaatcgcgcatcagccatggcgcggtgaatacgttcccgggccttgtacacaccgcccgtcaagccanggagttgggagtacctgaagagcgtagcgcttaagggtaataccagtgactggggc

SEQ ID NO: 1481 - DNA, 1285 bp, Porphyromonas sp.
  oral clone P4GB_100 P2
gatgaacgctagcgataggcttaacacatgcaagtcgagggaccggcgcacgggtgcgtaacgcgtatgcaacctgcctgtaattagggaataacccggtgaaagtcggactaataccctatattgaaagttgattacagatgggcatgcgtcccattagctggctggtaaggtaacggcttaccaaggcaacgatgggtagggggactgagaggttgacctcccacactggtactgagacacggaccagactcctacgggaggcagcagtgaggaatattggtcaatgggcgagagcctgaaccagccaagtcgcgtgaaggacgacggtttatggattgtaaacttcttttgtagaggaatatgcatgtactctacgaataagtatcggctaactccgtgccagcagccgcggtaatacggaggatacgagcgttatccggaattattgggtttaaagggtgcgtaggtggcgtattaagtcagtggtgaaaagctgcagctcaactgtagtcttgccgttgaaactgatatgctagagaggagacgaggtatgcggaatgtgtggtgtagcggtgaaatgcatagatatcacacagaacgccgattgcgaaggcagcgtaccaggctctctgacactgaagcacgaaagcgtggggatcaaacaggattagataccctggtagtccacgtagtaaacgatgaatactagatttttgcgtgtaagagtctaagcgaaagcgataagtattccacctggggagtacgccggcaacggtgaaactcaaaggaattgagggggcccgcacaagcggaggaacatgtggtttaattcgatgatacgcgaggaacttaccggggattgaatttagtaggtgctgcatggttgtcgtcagctcgtgccgtgaggtgtcggcttaagtgccataacgagcgcaacccgcgtcgatagttactaacagctgaggactctatcgagacagccgtcgtaagacggaggaaggggcggatgacgtcaaatcagcacggcccttacatccggggcgacacacgtgttacaatggcaggcaaagggaagcgacatggtgacatgaagcggatctcccctgtcccagttcggacggagtctgcaactcgactccggaagctggattcgctagtaatcgcgcatcagccatggcgcggtgaatacgttcccgggccttgtacacaccgcccgtcaagccatgggagtcgggggtacctgaagggcgtagcgcactagggtaataccggtgactggggc

SEQ ID NO: 1482 - DNA, 1532 bp, Porphyromonas uenonis
acaatggagagtttgactctggctcaggatgaacgctagcgataggcttaacacatgcaagtcgaggggcagcgagatgtagcaatacgtcgtcggcgaccggcgaatgggtgagtaacacgtatgcaacttacctcttagtggtgaataactcgatgaaagtcggactaatacaccatactctccttagatcacatgagaagaggaggaaagattaatcgctaagagataggcctgcgttccattagctagttggtaaggtaacggcttaccaaggcaacgatggatagggggactgagaggttgaccccccacattgacactgagatacgggtcaaactcctacgggaggcagcagtgaggaatattggtcaatgggcgagagcctgaaccagccaagtcgcgtgaaggaagactgcccgcaagggttgtaaacttcttttgtatgggattaaagtcgtctacgtgtagacgtttgcagttaccatacgaataagcatcggctaactccgtgccagcagccgcggtaatacggaggatgcgagcgttatccggaattattgggtttaaagggtgcgtaggttgcaagggaagtcaggggtgaaaagctatagctcaactatggtcttgcctttgaaactctctagctagagtgtactggaggtacgtggaacgtgtggtgtagcggtgaaatgcatagatatcacacagaactccgattgcgcaggcagcgtactacattacaactgacactgaagcacgaaagcgtgggtatcaaacaggattagataccctggtagtccacgcagtaaacgatgaatactagatctatgcgatatgacagtatgggtctaagcgaaagcgataagtattccacctggggagtacgccggcaacggtgaaactcaaagagattggcgggggtccgcacaagcggaggaacatgtggtttaattcgatgatacgcgaggaaccttacccgggattgaaatgtagatgcatgaggctgagaggtctcttcccttcggggcttctatgtaggtgctgcatggttgtcgtcagctcgtgccgtgaggtgtcggcttaagtgccataacgagcgcaacccgcgtcgatagttactaacgagttaagtcgaggactctatcgagacagccgtcgtaagacgagaggaaggagcggatgacgtcaaatcagcacggcccttacatccggggcgacacacgtgttacaatggtagggacagcgagcagccatctggcgacagagagctaatctataaaccctatcccagttcggatcggagtctgcaactcgactctgtgaagctggattcgctagtaatcgcgcatcagccatggcgcggtgaatacgttcccggaccttgcacacaccgcccgtcaagccatgggagtcgggggtacctgaagagcgtgaccgtcacaggagcgcttgagggtaaaactggtgactggggctaagtcgtaacaaggtagccgtaccggaaggtgcggctggaacacctcctttct

SEQ ID NO: 1483 - DNA, 1495 bp, Prevotella albensis
agagtttgatcctggctcaggatgaacgctagctacaggcttaacacatgcaagtcgaggggaaacgacagagagtgcttgcacactttgggcgtcgaccggcgaatgggtgagtaacgcgtatccaacctgcccttgacagagggatagcccagtgaaaactgaattaatacctcatgtcctcctccgacggcatcagacgaggagtaaagatttatcggtcaaggatggggatgcgtctgattaggtagtaggcggggtaacggcccacctagccgacgatcagtaggggttctgagaggaaggtcccccacattggtactgagacacggaccaaactcctacgggaggcagcagtgaggaatattggtcaatgggcggaagcctgaaccagccaagtagcgtgcaggacgacggccctatgggttgtaaactgcttttataggggaataaagttatccacgtgtggatatttgcatgtaccctatgaataaggaccggctaattccgtgccagcagccgcggtaatacggaaggtccgggcgttatccggatttattgggtttaaagggagcgtaggcggtatattaagcgtgttgtgaaatgtaggtgctcaacatctgacttgcagcgcgaactggtttacttgagtacgcacaacgtaggcggaattcgtcgtgtagcggtgaaatgcttagatatgacgaagaactccgattgcgaaggcagcttacgggagcgccactgacgctgaagctcgaaagtgcgggtatcgaacaggattagataccctggtagtccgcacggtaaacgatggatgcccgctctgagtccttttggatttggggccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcaggagaacgatccagagatggtgaggcccttcggggctcctgtgaaggtgctgcatggttgtcgtcagctcgtgccgtgaggtgtcggcttaagtgccataacgagcgcaacccctctccttagttgccatcaggtaatgctgggcactctggggacactgccaccgtaaggtgtgaggaaggtggggatgacgtcaaatcagcacggcccttacgtccggggctacacacgtgttacaatggcgtgtacagagagttggtgacatgcaaatgtcatctaatcctaaaagcacgtctcagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccggaaggatcggcctagggcaaaactggtaattggggctaagtcgtaacaaggtagccgt

SEQ ID NO: 1484 - DNA, 1491 bp, Prevotella amnii
agagtttgatcctggctcaggatgaacgctagctataggcttaacacatgcaagtcgaggggcagcatatagattgcttgcaatttatgatggcgaccggcgcacgggtgagtaacgcgtatccaacctacccattactagggaataacccagcgaaagttggcctaatgccctatgtagtcgtttgatcgcctgagatttcgacgaaagatttatcggtattggatggggatgcgtctgattagcttgttggcggggtaaaggcccaccaaggcgacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttatatgggaataaagtgagggacgtgtcccttattgcatgtaccatatgaataaggaccggctaattccgtgccagcagccgcggtaatacggaaggtccaggcgttatccggatttattgggtttaaagggagcgtaggctgtttgttaagcgtgttgtgaaatgtaagagctcaacttttagattgcagcgcgaactggcagacttgagtgcgcacaacgtaggcggaattcatggtgtagcggtgaaatgcttagatatcatgacgaactccgattgcgaaggcagcttacgggagcgcaactgacgctaaagctcgaaggtgcgggtatcgaacaggattagataccctggtagtccgcacagtaaacgatggatgcccgctgttagcacctagtgttagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagatgtttatatcagagatgatatattcccttcggggcatttgtgaaggtgctgcatggttgtcgtcagctcgtgccgtgaggtgtcggcttaagtgccataacgagcgcaacccctttttttagttgccatcaggtagtgctgggcactctagagatactgccaccgtaaggtgtgaggaaggtggggatgacgtcaaatcagcacggcccttacgtccggggctacacacgtgttacaatgggtggtacagagagttggttgtacgcaagtgcgatctaatcctaaaaaccattctcagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagttcgtgaccgtaaggatcgacctagggcaaaactggtaattggggctaagtcgtaacaaggtaacc

SEQ ID NO: 1485 - DNA, 1537 bp, Prevotella bergensis
ttacaatggagagtttgatcctggctcaggatgaacgctagctacaggcttaacacatgcaagtcgaggggaaacggcatttggtgcttgcaccatttggacgtcgaccggcgcacgggtgagtaacgcgtatccaacctgcccataagtagggtataacccgcagaaatgcggactaatcccctatgttgttcaaagacggcatcagatttgaaccaaaggcttgccgcttatggatggggatgcgtccgattagcttgttggtgaggtaacggctcaccaaggcttcgatcggtaggggttctgagaggaaggccccccacataggaactgagacacggtcctaactcctacgggaggcagcagtgaggaatattggtcaatgggcgagagcctgaaccagccaagtagcgtgcaggacgacggccctatgggttgtaaactgcttttatgcggggataaccggcctcacgtgtgaggccctgcaggtaccgcatgaataaggaccggctaattccgtgccagcagccgcggtaatacggaaggtccgggcgttatccggatttattgggtttaaagggagcgtaggccgtgggttaagtgtgttgtgaaatccggttgctcaacatccggtttgcagcgcatactgtcccacttgagtgcgcacaacgcaggcggaattcgtcgtgtagcggtgaaatgcttagatatgacgaggaaccccgattgcgaaggcagcttgcgggagcgcaactgacgcttaagctcgaaggtgcgggtatcaaacaggattagataccctggtagtccgcacggtaaacgatggatgcccgctgtttgccctttttgggcatgcggccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaactgccagtgaacgatacagagatgttgaggcccttcggggcgctggtggaggtgctgcatggttgtcgtcagctcgtgccgtgaggtgtcggcttaagtgccataacgagcgcaacccttttccacagttgccatcaggtcatgctgggcactctgtggatactgccgccgcaaggtgtgaggaaggtggggatgacgtcaaatcagcacggcccttacgtccggggctacacacgtgttacaatggggggcacagcgtgccgtacgtgcgcaagcacgttccaatcatgaaatcccccctcagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtaaccgcaaggggcggcctagggcaagaccggtgattggggctaagtcgtaacaaggtagccgtaccggaaggtgcggctggaacacctcctttct

SEQ ID NO: 1486 - DNA, 1533 bp, Prevotella bivia
ttacaatggagagtttgatcctggctcaggatgaacgctagctataggcttaacacatgcaagtcgaggggcagcgaatagatagcttgctatttatgtcggcgaccggcgcacgggtgagtaacgcgtatccaacctacccataactaagggataacccagcgaaagttggactaataccttatgtattcgtttgatctcatgagattacgaataaagatttatcggttatggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatggacgcaagtctgaaccagccaagtagcgtgcaggatgacggccctatgggttgtaaactgcttttatatggggataaagtggggaacgtgttcccttttgcaggtaccatatgaataaggaccggctaattccgtgccagcagccgcggtaatacggaaggttcgggcgttatccggatttattgggtttaaagggagcgtaggccgtttggtaagcgtgttgtgaaatgtagtagctcaacttctagattgcagcgcgaactgtcagacttgagtgcgcacaacgtaggcggaattcatggtgtagcggtgaaatgcttagatatcatgaagaactccgattgcgaaggcagcttacgggagcgcaactgacgctgaagctcgaaggtgcgggtatcgaacaggattagataccctggtagtccgcacagtaaacgatggatgcccgctgttagcacctagtgttagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagatgaacgatttagagataatgaggtccttcgggacatctgtgaaggtgctgcatggttgtcgtcagctcgtgccgtgaggtgtcggcttaagtgccataacgagcgcaacccctttctttagttgccatcaggttctgctgggcactctggagatactgccaccgtaaggtgtgaggaaggtggggatgacgtcaaatcagcacggcccttacgtccggggctacacacgtgttacaatgggtggtacagatagttggtcgtgtgcaaatacgatctaatccttaaaaccattctcagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagttcgtgaccgtaaggatcgacctagggcaaaactggtaattggggctaagtcgtaacaaggtagccgtaccggaaggtgcggctggaacacctcctttct

SEQ ID NO: 1487 - DNA, 1493 bp, Prevotella brevis
agagtttgatcctggctcaggatgaacgctagctacaggcttaacacatgcaagtcgaggggcatcatttcgaaagcttgcttttgaagatggcgaccggcgcacgggtgagtaacgcgtatccaaccttccccttagtagggcatagcccggcgaaagtcggattaataccctatgttctttayggatggcatctgaaataaagcaaagatttatcgctaagggatggggatgcgtctgattaggttgttggcggggtaacggcccaccaagcctacgatcagtaggggttctgagaggaaggtcccccacattggtactgagacacggaccaaactcctacgggaggcagcagtgaggaatattggtcaatgggcgagagcctgaaccagccaagtagcgtgcaggatgacggccctatgggttgtaaactgcttttgtcaggggataaaaaagrraacgtgttyyctattgcatgtacctgaagaataaggaccggctaattccgtgccagcagccgcggtaatacggaaggtccaggcgttatccggatttattgggtttaaagggagcgcaggctggagattaagcgtgacgtgaaatgccgcggctcaaccgtggaagtgcgtcgcgaactggtttccttgagtgtattcgacgtcagcggaattcgtggtgtagcggtgaaatgcttagatatcacgaagaactccgattgcgaaggcagctggcgaggctataactgacgctaaagctcgaaggtgcgggtatcgaacaggattagataccctggtagtccgcacggtaaacgatggatgcccgctgttggcgatatacggtcagcggccaagcgaaagcgttaagcatcccacctggggagtacgccggcaacggtgaaactcaaaggawttgacsggggcccgcacaagcggasgaacatgtggtttaattcgatgatacgcgaggaaccttacccgggcttgaactgcaggcgaacgattcagagatgatgaggcccttcggggcgcctgtggakgtgctgcatggttgtcgtcagctcgtgccgtgaggtgtcggcttaagtgccataacgagcgcaacccctctcttcagttgccatcaggtgawgctgggcactctggagacactgccaccgtaaggtgtgaggaaggtggggatgacgtcaaatcagcacggcccttacgtccggggctacacacgtgttacaatgggaggtacagagagacggtgtcyygcaarrtgcatcaaatccttaaagccttcctcagttcggattggggtctgcaacccgaccccatgaagctggattcgctagtaatcgcgcatcagccatggcgcggtgaatacgttcccgggccttgtacacaccgcccgtcaagccatgaaagccgggggcgcttgaagtccgtgaccgcaaggatcggcctagagcgaaactggtaattggggctaagtcgtaacaaggtagccgt

SEQ ID NO: 1488 - DNA, 1537 bp, Prevotella buccae
ttacaatggagagtttgatcctggctcaggatgaacgctggctacaggcttaacacatgcaagtcgaggggcagcatgccggttgcttgcaaccggtgatggcgaccggcgcacgggtgagtaacgcgtatccaaccttcccgcgaccaagggataacctgccgaaaggcagactaataccttatgtcctcctttgaaggcatctgacgaggagcaaagatccgtcggtcacggatggggatgcgtccgattagcttgttggcggggcaacggcccaccaaggcatcgatcggtaggggttctgagaggaaggccccccacactggaactgagacacggtccagactcctacgggaggcagcagtgaggaatattggtcaatgggcggaagcctgaaccagccaagtagcgtgcaggacgacggccctacgggttgtaaactgcttttatgcggggataaagttgcccacgcgtgggtttttgcaggtaccgcatgaataaggaccggctaattccgtgccagcagccgcggtaatacggaaggtccgggcgttatccggatttattgggtttaaagggagcgcaggccgccgtgcaagcgtgccgtgaaaagcagcggcccaaccgctgccctgcggcgcgaactgcttggcttgagtgcgccggaagcgggcggaattcgtggtgtagcggtgaaatgcttagatatcacgaagaaccccgattgcgaaggcagcccgctgtggcgccactgacgctgaggctcgaaggtgcgggtatcgaacaggattagataccctggtagtccgcacggtaaacgatggatacccgctgtccggcccgtacggtctgggcggccaagcgaaagcgttaagtatcccacctggggagtacgccggcaacggtgaaactcaaaggaattgacgggggcccgcacaagcggaggaacatgtggtttaattcgatgatacgcgaggaaccttacccgggcttgaattgcaggagaatgattcagagatgatgaagtccctcgggactcctgtgaaggtgctgcatggttgtcgtcagctcgtgccgtgaggtgtcggctcaagtgccataacgagcgcaacccctctccgcagttgccatcgggtgatgccgggcactctgcggacactgccgccgcaaggtgcgaggaaggtggggatgacgtcaaatcagcacggcccttacgtccggggccacacacgtgttacaatggccggtacagagggctgtccgcgcgcaagtgcgggtgaatcccctaaatccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccgcgagggtcggcctagggcaaaaccggtgattggggctaagtcgtaacaaggtagccgtaccggaaggtgcggctggaacacctcctttct

SEQ ID NO: 1489 - DNA, 1264 bp, Prevotella buccalis
ggctcaggatgaacgctagctacaggcttaacacatgcaagtcgcaggactggcgcacgggtgagtaacgcgtatccaaccttcccatgaccacgggataacccgttgaaagacggactaataccgtatgactaaagcggtgatggatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatgggcgagagcctgaaccagccaagtagcgtgcaggatgacggcctatgggttgtaaactgcttttatgcggggatatgcaggtaccgcatgaataaggaccggctaattccgtgccagcagccgcggtaatacggaaggtccgggcgttatccggatttattgggtttaaagggagcgtaggccgccaggtaagcgtgttgtgaaatgtaccggctcaaccggtgaattgcagcgcgaactgtctggcttgagtgcacggtaagcaggcggaattcatggtgtagcggtgaaatgcttagatatcatgaagaactccgattgcgaaggcagcttgctgcagtgactgacgctgatgctcgaaggtgcgggtatcaaacaggattagataccctggtagtccgcacggtaaacgatggatgcccgctgtccgccggcgggtggccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgtggaggtgctgcatggttgtcgtcagctcgtgccgtgaggtgtcggcttaagtgccataacgagcgcaaccccttttttcagttgccatcagctgggcactctggagatactgccaccgcaaggtggaggaaggtggggatgacgtcaaatcagcacggcccttacgtccggggctacacacgtgttacaatggggcacagagtgttggcttaacgcaagtttggtctaatcttctgtctcccagttcggatggggtctgcaacccgaccccagaagctggattcgctagtaatcgcgcatcagccatggcgcggtgaatacgttcccrggccttgtacacaccgcccgtcaagccatgaaagccgggggtgcctgaagtccgtag

SEQ ID NO: 1490 - DNA, 862 bp, Prevotella copri
  modified_base (185)..(185): a, c, t, g, unknown or other
  modified_base (637)..(637): a, c, t, g, unknown or other
  modified_base (836)..(836): a, c, t, g, unknown or other
cgtatccaacctgcccaccacttggggataaccttgcgaaagtaagactaatacccaatgacgtctctagaagacatctgaaagagattaaagatttatcggtgatggatggggatgcgtctgattagcttgttggcggggtaacggcccaccaaggcaacgatcagtaggggttctgagagganggtcccccacattggaactgagacacggtccaaactcctacgggaggcagcagtgaggaatattggtcaatggacgagagcctgaaccagccaagtagcgtgcaggatgacggccctatgggttgtaaactgcttttataagggaataaagtgagtctcgtgagactttttgcatgtaccttatgaataaggaccggctaattccgtgccagcagccgcggtaatacggaaggtccgggcgttatccggatttattgggtttaaagggagcgtaggccggagattaagcgtgttgtgaaatgtagacgctcaacgtctgcactgcagcgcgaactggtttccttgagtacgcacaaagtgggcggaattcgtggtgtagcggtgaaatgcttagatatcacgaagaactccgattgcgaaggcagctcactggagcgcaactgacgctgaanctcgaaagtgcgggtatcgaacaggattagataccctggtagtccgcacggtaaacgatggatgcccgctgttggtctgaataggtcagcggccaagcgaaagcattaagcatcccacctggggagtacgccggcaacggtgaaactcaaaggaattgacgggggcccgcacaagcggaggaacatgtggtttaattcnatgatacgcgaggaaccttacccggg

SEQ ID NO: 1491 - DNA, 1473 bp, Prevotella corporis
  modified_base (32)..(32): a, c, t, g, unknown or other
  modified_base (444)..(444): a, c, t, g, unknown or other
  modified_base (480)..(480): a, c, t, g, unknown or other
  modified_base (879)..(879): a, c, t, g, unknown or other
  modified_base (1024)..(1024): a, c, t, g, unknown or other
  modified_base (1114)..(1115): a, c, t, g, unknown or other
  modified_base (1420)..(1420): a, c, t, g, unknown or other
tacaatggagagtttgatcctggctcaggatnaacgctagctacaggcttaacacatgcaagtcgaggggaaacggcattaagtgcttgcactttttggacgtcgaccggcgcacgggtgagtaacgcgtatccaacctgccccttaccagggaataacccgttgaaagacggactaatgccctatggagtcctttgacggcatcagattaggactaaagattcatcggtatgggatggggatgcgtctgattagcttgttggcggggtaacggcccaccaaggcatcgatcagtaggggttctgagaggaaggtcccccacataggaactgagacacggtcctaactcctacgggaggcagcagtgaggaatattggtcaatgggcgctagcctgaaccagccaagtagcgtgcaggatgacggccctatgggttgtaaactncttttatgcggggataaagtcacccacgtgtgggtntttgcaggtaccgcatgaataaggaccggctaattccgtgccagcagccgcggtaatacggaaggtccgggcgttatccggatttattgggtttaaagggagtgtaggcggcctgttaagcgtgttgtgaaatgtagatgctcaacatctgaactgcagcgcgaactggctggcttgagtacacgcaacgtgggcggaattcatggtgtagcggtgaaatgcttagatatcatgaggaactcctattgcgaaggcagctcacgggagtgtcactgacgcttaagctcgaaggtgcgggtatcaaacaggattagataccctggtagtccgcacggtaaacgatggatgcccgctgttggcgctttgcgtcagcggctaagcgaaagcattaagcatccnacctggggagtacgccggcaacggtgaaactcaaaggaattgacgggggcccgcacaagcggaggaacatgtggtttaattcgatgatacgcgaggaaccttacccgggcttgaattgcagaggaaagatccagagatggtgatncccttcggggtctctgtgaaggtgctgcatggttgtcgtcagctcgtgccgtgaggtgtcggcttaagtgccataacgagcgcaaccccnntttccggttgccatcaggtgatgctgggcactccggggacactgccaccgtaaggtgtgaggaaggtggggatgacgtcaaatcagcacggcccttacgtccggggctacacacgtgttacaatggccggtacagagggcaggtgcaatgcaaattgcatcaaatctataaatccggtctcagttcggactggggtctgcaacccgaccccacgaagctggattcgctagtaatcgcgcatcagccatggcgcggtgaatacgttcccgggccttgtacacaccgcccgtcaagccatgaaagcngggggtgcctgaagttcgtaaccgcaaggagcgacctagggcaaaactggtga

SEQ ID NO: 1492 - DNA, 1483 bp, Prevotella dentalis
tggctcaggatgaacgctggctacaggcttaacacatgcaagtcgaggggcagcatggcggatgcttgcatctgccgatggcgaccggcgcacgggtgagtaacgcgtatccaacctaccttcaagcaggggacaatccgtagaaatgcggtctgataccctatgtattccaacgaggtcctccgtgttggaagaaaggtttatccgcttgttgatggggatgcgtccgattagcttgttggcggggcaacggcccaccaaggcaacgatcggtaggggttctgagaggaaggtcccccacactggaactgagacacggtccagactcctacgggaggcagcagtgaggaatattggtcaatgggcgtaagcctgaaccagccaagtagcgtgcaggatgacggccctatgggttgtaaactgcttttatacggggataaagtgcgccacgtgtggtgttttgcaggtaccgtatgaataaggaccggctaattccgtgccagcagccgcggtaatacggaaggtccgggcgttatccggatttattgggtttaaagggagcgtaggccgcatgtcaagcgtgttgtgaaatgcaggtgctcaacacctggattgcagcgcgaactgtcgtgcttgagtgtgcgcaacgttggcggaattcgtcgtgtagcggtgaaatgcttagatatgacgaggaaccccgattgcgaaggcagctgacgggagcataactgacgctgaagctcgaaggtgcgggtatcgaacaggattagataccctggtagtccgcacggtaaacgatggatgcccgccgtccgcccttttattgggcgtgtggccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagaggaacgatccagagatggtgaggcccttcggggcttctgcgaaggtgctgcatggttgtcgtcagctcgtgccgtgaggtgtcggctcaagtgccataacgagcgcaacccctctccgcagttgccatcgggtcatgccgggcactctgtggacactgccgccgcaaggtgtgaggaaggtggggatgacgtcaaatcagcacggcccttacgtccggggctacacacgtgttacaatggggggcacagcaagccggccgcgtgcaaacgcggtccaatcctgaaatcccccctcagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccggaaggatcggcctagggcaaaactggtgattggggctaagtcgtaacaaggtaacc

SEQ ID NO: 1493 - DNA, 1535 bp, Prevotella denticola
ttacagtggagagtttgatcctggctcaggatgaacgctggctacaggcttaacacatgcaagtcgaggggaaacggcattgagtgcttgcactgaatggacgtcgaccggcgcacgggtgagtaacgcgtatccaaccttcccgttactgcgggataacctgccgaaaggcagactaataccgcatgttcttcgatgacggcatcagattcgaagcaaagatccgtcggtaacggagggggatgcgtctgattagctagttggcggggcgacggcccaccaaggcgacgatcagtaggggttctgagaggaaggtcccccacattggaactgagacacggtccaaactcctacgggaggcagcagtgaggaatattggtcaatgggcggaagcctgaaccagccaagtagcgtgcaggatgacggccctacgggttgtaaactgcttttatgcggggataaagtgagggacgcgtccctttttgcaggtaccgcatgaataaggaccggctaattccgtgccagcagccgcggtaatacggaaggtccgggcgttatccggatttattgggtttaaagggagcgtaggccggggattaagtgtgttgtgaaatgtaggcgcccaacgtctgacttgcagcgcatactggttcccttgagtacgcgcaacgccggcggaattcgtcgtgtagcggtgaaatgcttagatatgacgaagaaccccgattgcgaaggcagccggcgggagcgcaactgacgctgaagctcgaaggtgcgggtatcgaacaggattagataccctggtagtccgcacggtaaacgatggatgcccgctgtcggcgccttgcgccggcggccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaatcgcaggagaacgatacagagatgttgaggtccttcgggactcctgcgaaggtgctgcatggttgtcgtcagctcgtgccgtgaggtgtcggcttaagtgccataacgagcgcaacccctctccccagttgccatcgggtgatgccgggcactccggggacactgccgccgcaaggtgcgaggaaggcggggatgacgtcaaatcagcacggcccttacgtccggggctacacacgtgttacaatggccggcacagagtgccggtgcggcgcgagccgcatccaatcttgaaaaccggtctcagttcggactggggtctgcaacccgaccccacgaagctggattcgctagtaatcgcgcatcagccacggcgcggtgaatacgttcccgggccttgtacacaccgcccgtcaagccatgaaagccgggagtgcctgaagtccgtgaccgcgaggatcggcctagggcaaaactggtgattggggctaagtcgtaacaaggtagccgtaccggaaggtgcggctggaacacctcctttct

SEQ ID NO: 1494 - DNA, 1535 bp, Prevotella disiens
ttacaatggagagtttgatcctggctcaggatgaacgctagctataggcttaacacatgcaagtcgaggggaaacggcagagagtgcttgcacactttggacgtcgaccggcgcacgggtgagtaacgcgtatccaacctgccctttacttggggataacccgttgaaagacggactaatacccaatgatattcattgatgacatctgatttgaattaaagatttatcggtataggatggggatgcgtctgattagcttgttggtgaggtaacggctcaccaaggccacgatcagtaggggttctgagaggaaggtcccccacattggaactgagacacggtccaaactcctacgggaggcagcagtgaggaatattggtcaatggacgagagtctgaaccagccaagtagcgtgcaggatgacggccctatgggttgtaaactgcttttgtttgggaataatcgacattacgtgtaatgttttgcatgtaccattcgaataaggaccggctaattccgtgccagcagccgcggtaatacggaaggtccaggcgttatccggatttattgggtttaaagggagtgtaggcggttggttaagcgtgttgtgaaatgtagatgctcaacatctgacttgcagcgcgaactggctgacttgagtacacacaacgtaggcggaattcatggtgtagcggtgaaatgcttagatatcatgaagaactccgattgcgaaggcagcttacgggagtgttactgacgcttaagctcgaaggtgcgggtatcgaacaggattagataccctggtagtccgcacagtaaacgatggatgcccgctgttagcacctggtgttagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtaggagcacgatacagagatgttgaggtccttcgggactcctatgaaggtgctgcatggttgtcgtcagctcgtgccgtgaggtgtcggcttaagtgccataacgagcgcaacccctttccttagttgccatcaggtaatgctgggcactctgaggatactgccaccgtaaggtgtgaggaaggtggggatgacgtcaaatcagcacggcccttacgtccggggctacacacgtgttacaatggccggtacagaatgttggttgcatgtaaatgtaatctaatctttaaagccggtcccagttcggactgaggtctgcaacccgacctcacgaagctggattcgctagtaatcgcgcatcagccatggcgcggtgaatacgttcccgggccttgtacacaccgcccgtcaagccatgaaagccgggggtgcctgaagttcgtaaccgcaaggagcgacctagggcaaaactggtaattggggctaagtcgtaacaaggtagccgtaccggaaggtgcggctggaacacctcctttct

SEQ ID NO: 1495 - DNA, 1310 bp, Prevotella sp.
  C1
gatgaacgctagctacaggcttaacacatgcaagtcgcgggaccggcgcacgggtgagtaacgcgtatccaacctgcccttcaccacgggataacccggcgaaagtcggactaataccgtatgttgaaaggcggtgagggatggggatgcgtccgattagcttgacggcggggtaacggcccaccgtggcgacgatcggtaggggttctgagaggaaggtcccccacactggaactgagacacggtccagactcctacgggaggcagcagtgaggaatattggtcaatgggcggaagcctgaaccagccaagtagcgtgcaggatgacggcctatgggttgtaaactgcttttatgcggggatatgcaggtaccgcatgaataaggaccggctaattccgtgccagcagccgcggtaatacggaaggtccgggcgttatccggatttattgggtttaaagggagcgtaggccgccccttaagcgtgttgtgaaatgcgggtgctcaacatccgacttgcagcgcgaactggggggcttgagtgcgccgaaagtaggcggaattcgtggtgtagcggtgaaatgcttagatatcacgaagaactccgattgcgaaggcagcttactgtagtgactgacgctgatgctcgaaagcgtgggtatcgaacaggattagataccctggtagtccacgcggtaaacgatggatgctcgttgtcggccggtcggtgaccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggaggtgctgcatggttgtcgtcagctcgtgccgtgaggtgtcggcttaagtgccataacgagcgcaacccccgtcttcagttgccatcggccgggcactctggagatactgccaccgcaaggtggaggaaggtggggatgacgtcaaatcagcacggcccttacgtccggggctacacacgtgttacaatggcgcacagagagtcggtggcatgcgagtgccatccaatcctttgcgtctcagttcggatggggtctgcaacccgaccccagaagctggattcgctagtaatcgcgcatcagccatggcgcggtgaatacgttcccgggccttgtacacaccgcccgtcaagccatgaaagccgggggcgcctgaagtccgtgtcggcctagggtgaaaccggtgattggggctaagtcgtaacaaggtagccgta

SEQ ID NO: 1496 - DNA, 1318 bp, Prevotella sp.
  C2
gatgaacgctagctacaggcttaacacatgcaagtcgagggaccggcgcacgggtgagtaacgcgtatccaaccttcccataactaaggaataccccgtagaaatgcggcctaatcccttatggttaaagtcggttatggatggggatgcgtctgattagcttgctggcggggtaacggcccaccagggcatcgatcagtaggggttctgagaggaaggtcccccacattggaactgagacacggtccaaactcctacgggaggcagcagtgaggaatattggtcaatgggcgagagcctgaaccagccaagtagcgtgcaggatgacggcctatgggttgtaaactgctttttaaggggaatatgcatgtacccttagaataaggaccggctaattccgtgccagcagccgcggtaatacggaaggtccaggtgttatccggatttattgggtttaaagggagcgtaggccgcaggttaagtgtgttgtgaaaagcagtcgcccaacgtctgccttgcagcgcaaactgtcctgcttgagtgcgcacaacgcaggcggaatccgtcgtgtagcggtgaaatgcttagatatgacgaagaactccgattgcgaaggcagcttgcgggagcgactgacgctgaagctcgaaagtgcgggtatcgaacaggattagataccctggtagtccgcacggtaaacgctggatgcccgtttttggctagtcagagaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctttcttcagttgccatcggccgggcactctgtagatactgccgccgtaaggtggaggaaggtggggatgacgtcaaatcagcacggcccttacgtccggggctacacacgtgttacaatggggggcagcgagcgggatgccgcaaggtcattcaaatcaacccccctcagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgttcggcctagggcaaaactggtaattggggctaagtcgtaacaaggtagccgtaccggaaggtgc

SEQ ID NO: 1497 - DNA, 1286 bp, Prevotella sp.
  P7 oral clone MB2_P31
gatgaacgctggctacaggcttaacacatgcaagtcgagggaccggcgcacgggtgagtaacgcgtatccaaccttcccgtcactgcgggataacctgccgaaaggcagactaataccgcatggctaaaggcggtgacggacggggatgcgtctgattagctggttggcggggcgacggcccaccaaggctacgatcagtaggggttctgagaggaaggtcccccacattggaactgagacacggtccaaactcctacgggaggcagcagtgaggaatattggtcaatgggcgcaagcctgaaccagccaagtagcgtgcaggacgacggcctatgggttgtaaactgcttttgtacggggatatgcaggtaccgtacgaataaggaccggctaattccgtgccagcagccgcggtaatacggaaggtccgggcgttatccggatttattgggtttaaagggagcgtaggccggggattaagtgtgttgtgaaatgtagacgctcaacgtctgacttgcagcgcatactggttcccttgagtacgcacaacgttggcggaattcgtcgtgtagcggtgaaatgcttagatatgacgaagaactccgattgcgaaggcagctgacgggggcgactgacgcttaagctcgaaggtgcgggtatcgaacaggattagataccctgctagtccgcacggtaaacgatggatgcccgctgttggtatatcagcggctaagcgaaagcattaagcatcccacctggggagtacgccggcaacggtggaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctctcttcagttgccatcagctgggcactctggagacactgccaccgtaaggtggaggaaggtggggatgacgtcaaatcagcacggcccttacgtccggggctacacacgtgttacaatggccggcagagggacggtgcaacgcaagttgcatccaatcttgccggtcccagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgttcggcctagggcaaaactggtgattggggc

SEQ ID NO: 1498 - DNA, 1287 bp, Prevotella sp.
  P8 oral clone MB3_P13
gatgaacgctggctacaggcttaacacatgcaagtcgagggaccggcgaatgggtgagtaacgcgtatccaacctgcccccggccggggtataacccgtcgaaaggcggcctaatcccccatgccgaaagccggccggggatggggatgcgtccgattagcttgctggcggggtaacggcccaccagggcttcgatcggtaggggttctgagaggaaggtcccccacactggtactgagacacggaccagactcctacgggaggcagcagtgaggaatattggtcaatgggcgcaagcctgaaccagccaagtagcgtgcgggatgaaggcctatgggtcgtaaaccgctttttcacggggatatgcaggtaccgtgcgaataaggaccggctaattccgtgccagcggccgcggtaatacggaaggtcctggcgttatccggatttattgggtttaaagggagcgcaggccgccccttaagcgtgttgtgaaaaccgggcgcccaacgcccggcgtgcagcgcgaactggggggcttgagtgcgcgcgacgccggcggaattcgtcgtgtagcggtgaaatgcttagatatgacgaggaaccccgattgcgaaggcagccggcgagggcgactgacgctgatgctcgaaggcgcgggtatcgaacaggattagataccatggtagtccgcgctgtaaacgatggatgcccgccgccggcatgtcggcggccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggaggtgctgcatggttgtcgtcagctcgtgccgtgaggtgtcggctcaagtgccataacgagcgcaacccctctccgcagttgccatcggccgggcactctgcggacactgccgccgcaaggtggaggaaggtggggacgacgtcaaatcagcacggcccttacgtccggggctacacacgtgttacaatggccggcagagagccgtccgggcgcgagcccggtccaatccctccggcctcagttcggatggggtctgcaacccgaccccagaagctggattcgctagtaatcgcgcatcagccatggcgcggtgaatacgttcccgggccttgtacacaccgcccgtcaagccatgaaagccgggggcgcctgaagtccgtgtcggcctagggcgataccggtgattggggc

SEQ ID NO: 1499 - DNA, 1282 bp, Prevotella sp.
  P9 oral clone MB7_G16
gatgaacgctagctacaggcttaacacatgcaagtcgagggaccggcgcacgggtgagtaacgcgtatccaaccttcccgctgcagggggataacccggtgaaagccggactaataccccataatcaaagcggcagcggatggggatgcgtccgattagttagttggtgaggtaacggctcaccaaggctttgatcggtaggggttctgagaggaaggccccccacattgggactgagacacggcccaaactcctacgggaggcagcagtgaggaatattggtcaatgggcgcaagcctgaaccagccaagtagcgtggaggacgactgcctatgggttgtaaactccttttatgcggggatatgcaggtaccgcatgaataaggaccggctaattccgtgccagcagccgcggtaatacggaaggtccgggcgttatccggatttattgggtttaaagggagcgcagactgcttgtcaagcgtgcagtgaaacgccgtggcccaaccacggtcctgctgcgcgaactggcttgcttgagtgggaggtacgcggaattcgtggtgtagcggtgaaatgcttagatatcacgaggaactccgattgtgaaggcagcgtaccatatccactgacgtttaggctcgaaggtgcgggtatcgaacaggattagataccctggtagtccgcacagtaaaccatggatgctcgctgtcggcgtgccggtggcctagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctctgcgtagttgccatcggccgggcactctgcgcacactgccaccgcaaggtggaggaaggtggggatgacgtcaaatcagcacggcccttacgtccggggctacacacgtgttacaatggcaggcagcgagtcgggagcatgcaaatgttctccaatcccccctgcctcagttcggatggggtctgcaacccgaccccagaagctggatccgctagtaatcgcgcatcagccatggcgcggtgaatacgttcccgggccttgtacacaccgcccgtcaagccatgaaagccgggggcgcctgaagtccgtgtcggcctagggcgagaccggtgattggggc

SEQ ID NO: 1500 - DNA, 1502 bp, Prevotella heparinolytica
gagtttgatcctggctcaggatgaacgctagctacaggcttaacacatgcaagtcgaggggcagcatgggcttagcttgctaagcccgatggcgaccggcgcacgggtgagtaacacgtatccaaccttccggtaactccggtatagcctttcgaaagaaagattaatcccggatagtatggtgattccgcatggtttctccattaaaggattccggttaccgatggggatgcgttccattaggcagttggcggggtaacggcccaccaaacctacgatggataggggttctgagaggaaggtcccccacattggaactgagacacggtccaaactcctacgggaggcagcagtgaggaatattggtcaatgggcggaagcctgaaccagccaagtagcgtgaaggatgactgccctatgggttgtaaacttcttttataagggaataattgtgggtacgcgtacccatttgcatgtaccttatgaataaggatcggctaactccgtgccagcagccgcggtaatacggaggatccgagcgttatccggatttattgggtttaaagggagcgtaggcgggcgcttaagtcagctgtgaaagtttggggctcaaccttaaaattgcagttgatactgggtgccttgagtgcagtataggcaggcggaattcgtggtgtagcggtgaaatgcttagatatcacgaagaactcctattgcgaaggcagcttgctggagtgtaactgacgctgatgctcgaaagtgtgggtatcaaacaggattagataccctggtagtccacacagtaaacgatgaatactcgctgtttgcgatatactgcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaaccgaattatccggaaacgggtaagccgcaaggcggttgtgaaggtgctgcatggttgtcgtcagctcgtgccgtgaggtgtcggcttaagtgccataacgagcgcaacccttatccacagttaccatcaggtgatgctggggactctgtggagactgccgtcgtaagatgcgaggaagggggggatgacgtcaaatcagcacggcccttacgtccggggctacacacgtgttacaatggggggtacagcaggcagctcggcggcgacgcccggccaatccctaaatcccctctcagttcggactggagtctgcaacccgactccacgaagctggattcgctagtaatcgcgcatcagccacggcgcggtgaatacgttcccgggccttgtacacaccgcccgtcaagccatgaaagccgggggtacctgaagtgcgtaaccgtccaggagcgccctagggtaaaaccggtgattggggctaagtcgtaacaaggtagccgtaccggaaggtgc

SEQ ID NO: 1501 - DNA, 1266 bp, Prevotella histicola
ggctcaggatgaacgctagctacaggcttaacacatgcaagtcgagggaccggcgcacgggtgagtaacgcgtatccaaccttcccatgactaagggataacctgccgaaaggcagactaataccttatrgttaaagtcggttatggatggggatgcgtctgattagcttgttggcggggtaacggcccaccaaggcracgatcagtaggggttctgagaggaaggtcccccacattggaactgagacacggtccaaactcctacgggaggcagcagtgaggaatattggtcaatgggcgagagcctgaaccagccaagtagcgtgcaggatgacggcctatgggttgtaaactgcttttgtatggggatatgcaggtaccatacgaataaggaccggctaattccgtgccagcagccgcggtaatacggaaggtccgggcgttatccggatttattgggtttaaagggagcgtaggctggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgactgacgctgaagctcgaaggtgcgggtatcgaacaggattagataccctggtagtccgcacagtaaacgatggatgcccgctgttggtatatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctgtctttagttgccatcagctgggcactctggagatactgccaccgtaaggtggaggaaggtggggatgacgtcaaatcagcacggcccttacgtccggggctacacacgtgttacaatggccggcagagggacggtgtaatgtaaattgcatccaatcttgccggtcccagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgtacc

SEQ ID NO: 1502 - DNA, 1364 bp, Prevotella intermedia
gatgaacgctagctataggcttaacacatgcaagtcgaggggaaacggcattatgtgcttgcacattctggacgtcgaccggcgcacgggtgagtatcgcgtatccaaccttccctccactcggggataccccgttgaaagacggcctaatacccgatgttgtccacatatggcatctgacgtggaccaaagattcatcggtggaggatggggatgcgtctgattagcttgttggtgcgggtaacggcccaccaaggcgacgatcagtaggggttctgagaggaaggtcccccacattggaactgagacacggtccaaactcctacgggaggcagcagtgaggaatattggtcaatggacggaagtctgaaccagccaagtagcgtgcaggattgacggccctatgggttgtaaactgcttttgttggggagtaaagtggggcacgcgtgcccttttgcatttacccttcgaataaggaccggctaattccgtgccagcagccgcggtaatacggaaggtccaggcgttatccggatttattgggtttaaagggagtgtaggcggtctgttaagcgtgttgtgaaatttaggtgctcaacatctaacttgcagcgcgaactggcggacttgagtgcacgcaacgtatgcggaattcatggtgtagcggtgaaatgcttagatatcatgacgaactccgattgcgaaggcagcgtacgggagtgttactgacgcttaagctcgaaggtgcgggtatcgaacaggattagataccctggtagtccgcacggtaaacgatggatgcccgctgttagcgcctggcgttagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagacgcaggatacagagatgttgactcccttcggggcgtctgtgaaggtgctgcatggttgtcgtcagctcgtgccgtgaggtgtcggcttaagtgccataacgagcgcaacccctttccttagttgccatcaggtgatgctgggcactctggggatactgccaccgcaaggtgtgaggaaggtggggatgacgtcaaatcagcacggcccttacgtccggggctacacacgtgttacaatggccggtacagagggacggtgcgatgcaaatcgcatccaatcttgaaagccggtcccagttcggactgaggtctgcaacccgacctcacgaagctggattcgctagtaatcgcgcatcagccatggcgcggtgaatacgttcccgggcctt

SEQ ID NO: 1503 - DNA, 1200 bp, Prevotella loescheii
taacgcgtatccaacctgcccttcaccacgggataacccggcgaaagtcggactaataccgtatgttgaaagcggtgarggatggggatgcgtccgattagctkgacggcggggtaacggcccaccgtggctacgatcggtaggggttctgagaggaaggtcccccacactggaactgagacacggtccagactcctacgggaggcagcagtgaggaatattggtcaatgggcgtaagcctgaaccagccaagtagcgtgcaggatgacggcctatgggttgtaaactgcttttatgcggggatatgcaggtaccgcatgaataaggaccggctaattccgtgccagcagccgcggtaatacggaaggtccgggcgttatccggatttattgggtttaaagggagcgtaggccgcgccttaagcgtgttgtgaaatccgggtgctcaacatccggcttgcagcgcgaactggggcgcttgagtgcgcwgaaagtaggcggaattcgtggtgtagcggtgaaatgcttagatatcacgaggaactccgattgcgaaggcagcctactgtagcgactgacgctgatgctcgaaagcgtgggtatcgaacaggattagataccctggtagtccacgcggtaaacgatggatgctcgttgtcggccggtcggtgaccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggaggtgctgcatggttgtcgtcagctcgtgccgtgaggtgtcggcttaagtgccataacgagcgcaacccccgtcttcagttgccatcggccgggcactctggagatactgccaccgcaaggtggaggaaggtggggatgacgtcaaatcagcacggcccttacgtccggggctacacacgtgttacaatggcgcacagagagtcggtggcatgcgaatgccatccaatcctctgcgtctcagttcggatggggtctgcaacccgaccccagaagctggattcgctagtaatcgcgcatcagccatggcgcggtgaatacgttcccgggccttgtacacaccgcccgtcaagccatgaaagccgggggcgcctgaagtccgtacc

SEQ ID NO: 1504 - DNA, 1520 bp, Prevotella maculosa
agagtttgatcctggctcaggatgaacgctagctacaggcttaacacatgcaagtcgaggggaaacgatgagagagcttgctctcttaggtgtcgaccggcgcacgggtgagtaacgcgtatccaacctgcctctgaccaagggataacccgtcgaaagtcggactaataccttatgcagtcgtcggaagtcatctgatgacgacgaaagatttcatcggtgagggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatgggcgcgagcctgaaccagccaagtagcgtgcaggatgacggccctatgggttgtaaactgcttttatgcggggataaagtgagggacgtgtccttcattgcaggtaccgcatgaataaggaccggctaattccgtgccagcagccgcggtaatacggaaggtccgggcgttatccggatttattgggtttaaagggagcgtaggccgtggattaagcgtgttgtgaaatgtagacgctcaacgtctgacttgcagcgcgaactggtccacttgagtgtgcacaacgcaggcggaattcgtcgtgtagcggtgaaatgcttagatatgacgaagaaccccgattgcgaaggcagcttgcgggagcacgactgacgctgaagctcgaaagtgcgggtatcgaacaggattagataccctggtagtccgcacggtaaacgatggatgcccgttgtcaggctgtatcagtctggtgaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagacgaacgattcagagatgaagaggcccttcggggcgtctgtgaaggtgctgcatggttgtcgtcagctcgtgccgtgaggtgtcggcttaagtgccataacgagcgcaacccctattctcggttgccatcgggtaatgccgggcactccgtggagactgccaccgtaaggtgtgaggaaggtggggacgacgtcaaatcagcacggcccttacgtccggggctacacacgtgttacaatggccggtacagcgagtcggccgcatgcaaatgcggtccaatcctgaaagccggtcccagttcggaccggggtctgcaacccgaccccgcgaagccggattcgctagtaatcgcgcatcagccatggcgcggtgaatacgttcccgggccttgtacacaccgcccgtcaagccatgaaagccgggggtgcctgaagtccgttaccgcgagggtcggcctaaggcaaaaccggtgattggggctaagtcgtaacaaggtagccgtaccggaaggtgcggctggaacacct

SEQ ID NO: 1505 - DNA, 1534 bp, Prevotella marshii
ttacaatgtagagtttgatcctggctcaggatgaacgctagctacaggcttaacacatgcaagtcgcggggcagcatggggattgcttgcaatctctgatggcgaccggcgcacgggtgagtaacacgtatccaacctgcctattaccacggtataacccgatgaaagtcggcctaatcccgtatgtagtcttccaatggcatcagcagtagacgaaaggtttagcggtaatggatggggatgcgtccgattagctagtcggtgaggtaacggctcaccgaggcaacgatcggtaggggttctgagaggaaggtcccccacactggaactgagacacggtccagactcctacgggaggcagcagtgaggaatattggtcaatgggcgagagcctgaaccagccaagtagcgtgcaggatgacggccttatgggttgtaaactgcttttatgcgaggataaagttacccacgtgtgggtgtttgcaggtatcgcatgaataaggaccggctaattccgtgccagcagccgcggtaatacggaaggttctggcgttatccggatttattgggtttaaagggagcgtaggctgttttttaagcgtgttgtgaaatgtaccggctcaaccggtgatgtgcagcgcgaactggaagacttgagtgtgttgtaagtaggcggaattcgtggtgtagcggtgaaatgcttagatatcacgaggaactccgattgcgtaggcagcttactgtctcactactgacgctgatgctcgaaagcgcgggtatcgaacaggattagataccctggtagtccgcgcggtaaacgatggatgctcgttgttggtatatatatatcagtgacttagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgccggcgaacgattcagagatgatgaggcctttcggggcgccggtggaggtgctgcatggttgtcgtcagctcgtgccgtgaggtgtcggcttaagtgccataacgagcgcaacccctttttatagttgccatcgggtaatgccgggcactctgtagatactgccaccgtaaggtgtgaggaaggtggggatgacgtcaaatcagcacggcccttacgtccggggctacacacgtgttacaatggcgcatacagagagttggttgtatgtaaatacggtctaatcttgaaagtgcgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctgaagtccgtgaccgcgagggtcggcctagggtgaaaccggtgattggggctaagtcgtaacaaggtagccgtaccggaaggtgcggctggaacacctcctttct

SEQ ID NO: 1506 - DNA, 1535 bp, Prevotella melaninogenica
ttacaatggagagtttgatcctggctcaggatgaacgctagctacaggcttaacacatgcaagttgaggggaaacggcattgagtgcttgcactctttggacgtcgaccggcgcacgggtgagtaacgcgtatccaaccttcccattactgtgggataacctgccgaaaggcagactaataccgcatagtcttcgatgacggcatcagatttgaagtaaagatttatcggtaatggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatggacggaagtctgaaccagccaagtagcgtgcaggatgacggccctatgggttgtaaactgcttttgtatggggataaagttagggacgtgtccctatttgcaggtaccatacgaataaggaccggctaattccgtgccagcagccgcggtaatacggaaggtccaggcgttatccggatttattgggtttaaagggagcgtaggctggagattaagtgtgttgtgaaatgtagacgctcaacgtctgaattgcagcgcatactggtttccttgagtacgcacaacgttggcggaattcgtcgtgtagcggtgaaatgcttagatatgacgaagaactccgattgcgaaggcagctgacgggagcgcaactgacgcttaagctcgaaggtgcgggtatcaaacaggattagataccctggtagtccgcacagtaaacgatggatgcccgctgttggtacctggtatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagaggaaggatttagagataatgacgcccttcggggtctctgtgaaggtgctgcatggttgtcgtcagctcgtgccgtgaggtgtcggcttaagtgccataacgagcgcaacccctctcttcagttgccatcaggttaagctgggcactctggagacactgccaccgtaaggtgtgaggaaggtggggatgacgtcaaatcagcacggcccttacgtccggggctacacacgtgttacaatggccggtacagagggacggtgtaatgcaaattgcatccaatcttgaaagccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccgcaaggatcggcctagggcaaaactggtgattggggctaagtcgtaacaaggtagccgtaccggaaggtgcggctggaacacctcctttct

SEQ ID NO: 1507 - DNA, 1517 bp, Prevotella micans
agagtttgatcctggctcaggatgaacgctagctacaggcttaacacatgcaagtcgaggggcagcataattattgcttgcaataattgatggcgaccggcgcacgggtgagtatcgcgtatccaactttcccataactaggggataatccgtcgaaaggcggtctaatactctatgttgtctatttatggcctcatatttagacgaaagatttatcggttatggttagggatgcgtccgattaggtagtaggcggggtaatagcccacctagcctacgatcggtaggggttctgcgaggaaggtcccccacattggaactgagacacggtccaaactcctacgggaggcagcagtgaggaatattggtcaatggacgcgagtctgaaccagccaagtagcgtgcaggatgacggccctatgggttgtaaactgcttttatgcgggaataaagtgatttacgtgtatatcattgcatgtaccgcatgaataaggaccggctaattccgtgccagcagccgcggtaatacggaaggttcgggcgttatccggatttattgggtttaaagggagcgtaggctgaatattaagcgtgttgtgaaatgtagttgctcaacatctgcactgcagcgcgaactggtattcttgagtgtgcgcgacgtaggcggaattcgtggtgtagcggtgaaatgcttagatatcacgaagaactccgattgcgaaggcagcttacgagagcacaactgacgcttaagctcgaaggtgcgggtatcgaacaggattagataccctggtagtccgcacagtaaacgatggatgcccgctattggacttttagttcagtggctaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgccggtgaacgatacagagatgttgaggcccttcggggcgccggtggaggtgctgcatggttgtcgtcagctcgtgccgtgaggtgtcggcttaagtgccataacgagcgcaaccccattttctagttgccatcgggtaatgccgggcactctggagatactgccaccgtaaggtgtgaggaaggttgggatgacgtcaaatcagcacggcccttacgtccggggctacacacgtgttacaatggcgcatacagagtgtcggttgtatgtaaatgcaatccaatcttgaaagtgcgtctcagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccgcaagggtcggcctagggcaaaaccggtgattggggctaagtcgtaacaaggtagccgtaccggaaggtgcggctggaacacct

SEQ ID NO: 1508 - DNA, 1537 bp, Prevotella multiformis
ttacagtggagagtttgatcctggctcaggatgaacgctggctacaggcttaacacatgcaagtcgaggggaaacggcgttgagtgctcgcactcttcggacgtcgaccggcgcacgggtgagtaacgcgtatccaaccttcccgtcactgcgggataacctgccgaaaggcagactaataccgcatggccttcactgacggcatcagaggtgaagtaaagctttttagcggtgacggacggggatgcgtctgattagctggttggcggggcgacggcccaccaaggctacgatcagtaggggttctgagaggaaggtcccccacattggaactgagacacggtccaaactcctacgggaggcagcagtgaggaatattggtcaatgggcggaagcctgaaccagccaagtagcgtgcaggaggacggccctacgggttgtaaactgcttttatgcggggataaagtgagggacgcgtccctttttgcaggtaccgcatgaataaggaccggctaattccgtgccagcagccgcggtaatacggaaggtccgggcgttatccggatttattgggtttaaagggagcgtaggccggggattaagtgtgttgtgaaatgtaggcgctcaacgtctgatgtgcagcgcatactggttcccttgagtacgcgcaacgccggcggaattcgtcgtgtagcggtgaaatgcttagatatgacgaagaaccccgattgcgaaggcagccggcgggagcgcaactgacgctgaagctcgaaggtgcgggtatcgaacaggattagataccctggtagtccgcacggtaaacgatggatgcccgctctcggcgcctggcgccgggggccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaattgcaggagaacgatacagagatgttgaggtccttcgggactcctgcgaaggtgctgcatggttgtcgtcagctcgtgccgtgaggtgtcggctcaagtgccataacgagcgcaacccctctccccagttgccatcgggttatgccgggcactccggggacactgccgccgcaaggtgcgaggaaggtggggatgacgtcaaatcagcacggcccttacgtccggggctacacacgtgttacaatggccggtacagagggctggcgctccgcgaggcgcgccgaatctataaagccggtctcagttcggactggggtctgcaacccgaccccacgaagctggattcgctagtaatcgcgcatcagccacggcgcggtgaatacgttcccgggccttgtacacaccgcccgtcaagccatgaaagccgggggtgcctgaagtccgtgaccgcgaggatcggcctagggcaaaactggtgattggggctaagtcgtaacaaggtagccgtaccggaaggtgcggctggaacacctcctttct

SEQ ID NO: 1509 - DNA, 1516 bp, Prevotella multisaccharivorax
agagtttgatcctggctcaggatgaacgctagctacaggcctaacacatgcaagtcgaggggaaacgaagcgggagcttgcttctgctgtcgtcgaccggcgcacgggtgagtaacgcgtatccaacctggcctgaggtaagggataatccgcagaaatgtggtctaataccttatgtgctcctatgaggtcatctgaagaggagcaaagatttatcgccttaggatggggatgcgtctgattagatagttggcggggcaacggcccaccaagtcatcgatcagtaggggttctgagaggaaagtcccccacattggaactgagacacggtccagactcctacgggaggcagcagtgaggaatattggtcaatgggcgagagcctgaaccagccaagtagcgtgcaggatgacggccctatgggttgtaaactgcttttatgcgggtataaaggagcatacgtgtatgtttttgcagttaccgcatgaataaggaccggctaattccgtgccagcagccgcggtaatacggaaggttctggtgttatccggatttattgggtttaaagggagcgcaggctgtcagataagcgtgttgtgaaatgcggttgctcaacatccgcactgcagcgcgaactgtttgacttgagtacgcacgacgttggtggaatttgccgtgtagcggtgaaatgcttagatatggcgaagaactccgattgcgaaggcagctgacgggagcgctactgacgctcatgctcgaaagtgcgggtatcgaacaggattagataccctggtagtccgcacggtaaacgctggatgcccgctatatgcccctttagggtatgtggccaagtgaaaacgttaagcatcccacctggggagtacgccggcaacggtgaaactcaaaggaattgacgggggcccgcacaagcggaggaacatgtggtttaattcgatgatacgcgaggaaccttacccgggcttgaattgctgaggaaggcttcagagatggagctgcccttcggggcttcagtgaaggtgctgcatggttgtcgtcagctcgtgccgtgaggtgtcggcttaagtgccataacgagcgcaacccttttcttcagttgccatcaggtagtgctgggccctctggagatactgccgccgtaaggtgtgaggaaggtggggatgacgtcaaatcagcacggcccttacgtccggggctacacacgtgttacaatgggtggtacagcgagcagggttaccgcaaggtatcccgaatcattaaatccgccctcagttcggactggggtctgcaacccgaccccacgaagctggattcgctagtaatcgcgcatcagccatggcgcggtgaatacgttcccgggccttgtacacaccgcccgtcaagccatgaaagccggggggtgcctgaagtccgtgaccgcaaggatcggcctagggcaaaaacttgggtaattgggggctaagtcgtaacaaggtagccgtaccggaaggtgcggctg

SEQ ID NO: 1510 - DNA, 1268 bp, Prevotella nanceiensis
ctggctcaggatgaacgctagctacaggcttaacacatgcaagtcgagggaccggcgcacgggtgagtaacgcgtatccaacctacccaatactcaggcataacccgttgaaagacggactaattcctgatggttaaagtcggtattggatggggatgcgtctgattagtttgttggtgaggtaacggctcaccaagacttcgatcagtaggggttctgagaggaaggtcccccacattggaactgagacacggtccaaactcctacgggaggcagcagtgaggaatattggtcaatggatggaaatctgaaccagccaagtagcgtgcaggatgacggcctatgggttgtaaactgcttttatgtgagaatatgcatgtatcacatgaataaggaccggctaattccgtgccagcagccgcggtaatacggaaggtccaggcgttatccggatttattgggtttaaagggtgcgtaggccgtttgataagcgtgctgtgaaatatagtggctcaacctctatcgtgcagcgcgaactgttgaacttgagtgcgtagtaggtaggcggaattcgtggtgtagcggtgaaatgcttagatatcacgaagaactccgattgcgaaggcagcttaccgtaacgactgacgcttaagcacgaaggtgcgggtatcgaacaggattagataccctggtagtccgcacagtaaacgatggatgctcgctgttggccggtcagtggcttagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgtggaggtgctgcatggttgtcgtcagctcgtgccgtgaggtgtcggcttaagtgccataacgagcgcaaccccttttcttagttgccatcagctgggcactctgggaatactgccaccgtaaggtggaggaaggtggggatgacgtcaaatcagcacggcccttacgtccggggctacacacgtgttacaatggcgcacagagtgttggtttcatgcaaatgagatctaatcttctgcgtctcagttcggatggggtctgcaacccgaccccagaagctggattcgctagtaatcgcgcatcagccatggcgcggtgaatacgttcccgggccttgtacacaccgcccgtcaagccatgaaagccgggggcgcctaaagtccgtacc

SEQ ID NO: 1511 - DNA, 1520 bp, Prevotella nigrescens
agagtttgatcctggctcaggatgaacgctggctacaggcttaacacatgcaagtcgtggggaaacggcattatgtgcttgcacattctggacgtcgaccggcgcacgggtgagtatcgcgtatccaacctgccccttacttggggataccccgttgaaagacggcctaatacccgatgtgtttcattgacggcatccgatatgaaacaaaggttttccggtaagggatggggatgcgtctgattagctagttggcggggcaacggcccaccaaggcgacgatcagtaggggttctgagaggaaggtcccccacattggaactgagacacggtccaaactcctacgggaggcagcagtgaggaatattggtcaatggacgcaagtctgaaccagccaagtagcgtgcaggatgacggccctatgggttgtaaactgcttttatgtgggaataaattggcgcacgtgtgcgccattgcatgtacctcatgaataaggaccggctaattccgtgccagcagccgcggtaatacggaaggtccgggcgttatccggatttattgggtttaaagggagtgtaggcggtctgttaagcgtgttgtgaaatttaggtgctcaacatttaacttgcagcgcgaactgtcagacttgagtacacgcagcgcaggcggaattcatggtgtagcggtgaaatgcttagatatcatgaggaactccgatcgcgaaggcagcctgcgggagtgttactgacgcttaagctcgaaggtgcgggtatcgaacaggattagataccctggtagtccgcactgtaaacgatggatgcccgccgttggcgccctgcgcctgcggccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagtcgcagcccacagagacgtgggcttcccttcggggcgtctgtgaaggtgctgcatggttgtcgtcagctcgtgccgtgaggtgtcggcttaagtgccataacgagcgcaaccccctttcccagttgccatcgggttatgccgggcactctggggacactgccaccgcaaggtgcgaggaaggtggggatgacgtcaaatcagcacggcccttacgtccggggctacacacgtgttacaatggccggtacagagggacggtgcaatgcaagttgcatccaatcttgaaatccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagttcgtgaccgcgaggagcgacctagggcaagaccggtgattggggctaagtcgtaacaaggtagccgtaccggaaggtgcggctggaacacct

SEQ ID NO: 1512 - DNA, 1539 bp, Prevotella oralis
ttacaatgtagagtttgatcctggctcaggatgaacgctagctacaggcttaacacatgcaagtcgcggggcatcatggaggttgttttcaacttttgatggcgaccggcgcacgggtgagtaacgcgtatccaaccttcccattactacggcataccccgttgaaaggcggcctaattccgtatgcagtccgaagcagtcatctaatttggacgaaaggtatattctatcggtaatggatggggatgcgtccgattagccagccggcggggtaacggcccaccggggcatcgatcggtaggggttctgagaggaaggtcccccacactggaactgagacacggtccagactcctacgggaggcagcagtgaggaatattggtcaatgggcgtaagcctgaaccagccaagtagcgtgcaggatgacggccctatgggttgtaaactgcttttatgcggggataaagttggggacgtgtccctttttgcaggtaccgcatgaataaggaccggctaattccgtgccagcagccgcggtaatacggaaggtccgggcgttatccggatttattgggtttaaagggagcgtaggcagttttttaagcgtgctgtgaaatgtaccggctcaaccggtgatgtgcagcgcgaactgggaatcttgagtacgcagtaagcaggcggaattcgtggtgtagcggtgaaatgcttagatatcacgaagaactccgattgcgtaggcagcttgctgtagcgtaactgacgctgaagctcgaaagtgcgggtatcgaacaggattagataccctggtagtccgcacggtaaacgatggatgcccgctgtcggccttttttggtcggtggccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgccattgacttgaatagagatattcattcccttcggggcattggtggaggtgctgcatggttgtcgtcagctcgtgccgtgaggtgtcggcttaagtgccataacgagcgcaaccccttttttcagttgccatcggttaaagccgggcactctgtgaatactgccgccgtaaggtgtgaggaaggtggggatgacgtcaaatcagcacggcccttacgtccggggctacacacgtgttacaatggcgcgtacagcgagtcggccgtatgtaaatgcggtccaatccttaaaacgtgcctcagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccgcaagggtcggcctaaggcaatactggtaattggggctaagtcgtaacaaggtagccgtaccggaaggtgcggctggaacacctcctttct

SEQ ID NO: 1513 - DNA, 1536 bp, Prevotella oris
ttacaatggagagtttgatcctggctcaggatgaacgctggctacaggcttaacacatgcaagtcgaggggaaacgacggggaagcttgcttccccgggcgtcgaccggcgcacgggtgagtaacgcgtatccaacctgcctctgactgagggataacccgtcgaaagtcggcctaatacctcatggcatcgtctgcgggcatccaacgacgattaaagatttcatcggtcagggatggggatgcgtctgattagcttgttggcggggtaacggcccaccaaggctacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttatgcggggataaagtgagggacgtgtccttcattgcaggtaccgcatgaataaggaccggctaattccgtgccagcagccgcggtaatacggaaggtccgggcgttatccggatttattgggtttaaagggagcgtaggccgtggattaagcgtgttgtgaaatgcaggtgctcaacgtctgcactgcagcgcgaactggtccacttgagtgtgcgcaacgcaggcggaattcgtcgtgtagcggtgaaatgcttagatatgacgaagaactccgattgcgaaggcagcttgcgggagcacaactgacgctgaagctcgaaagtgcgggtatcgaacaggattagataccctggtagtccgcacggtaaacgatggatgcccgttgtcaggctgtttcagcctggtgaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagacgaaggcttcagagatgaagcggcccttcggggcgtctgtgaaggtgctgcatggttgtcgtcagctcgtgccgtgaggtgtcggcttaagtgccataacgagcgcaacccctttcttcagttgccatcaggtgatgctgggcactctggagacactgccaccgcaaggtgtgaggaaggtggggatgacgtcaaatcagcacggcccttacgtccggggctacacacgtgttacaatggccggtacagagagttgattttgtgcaaacacgatctaatccttaaatccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtctgtgaccgcaaggaacggcctagggcaaaaccggtgattggggctaagtcgtaacaaggtagccgtaccggaaggtgcggctggaacacctcctttct

SEQ ID NO: 1514 - DNA, 1513 bp, Prevotella oulorum
  modified_base (3)..(3): a, c, t, g, unknown or other
acnatggagagtttgatcctggctcaggatgaacgctagctacaggcttaacacatgcaagtcgaggggaaacgatgacgagagcttgctctcttaggcgtcgaccggcgcacgggtgagtaacgcgtatccaacctgcccattacaggggaataaccttgcgaaagtaagactaatgccccatggtattctcagcagacatctaatgaggattaaagatttatcggtaatggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatgggcgagagcctgaaccagccaagtagcgtgcaggaagacggccctatgggttgtaaactgcttttataggggaataaagtgatctacgtgtagtttattgtatgtaccctatgaataaggaccggctaattccgtgccagcagccgcggtaatacggaaggttcgggcgttatccggatttattgggtttaaagggagcgtaggccgtagattaagcgtgttgtgaaatgtagatgctcaacatctgacttgcagcgcgaactggtttacttgagtgtgcacaacgtaggcggaattcgtcgtgtagcggtgaaatgcttagatatgacgaagaactccgattgcgaaggcagcttacgggagcacaactgacgctgaagctcgaaggtgcgggtatcaaacaggattagataccctggtagtccgcacagtaaacgctggatgcccgctgttggctcattagagtcagcggccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagacgaacgattcagagatgaagaggcccttcggggcgtctgtgaaggtgctgcatggttgtcgtcagctcgtgccgtgaggtgtcggcttaagtgccataacgagcgcaaccccttttcttagttgccatcaggtcatgctgggcactctgggaatactgccaccgtaaggtgtgaggaaggtggggatgacgtcaaatcagcacggcccttacgtccggggctacacacgtgttacaatggccggtacagagggcaggttgcatgtaaatgcgatcgaatcttaaaagccggtcccagttcggactgaggtctgcaacccgacctcacgaagctggattcgctagtaatcgcgcatcagccatggcgcggtgaatacgttcccgggccttgtacacaccgcccgtcaagccatgaaagccgggggtgcctaaagtccgttaccgcaaggatcggcctagggcaaaactggtaattggggctaagtcgtaacaaggtagccgtaccggaaggtgc

SEQ ID NO: 1515 - DNA, 1519 bp, Prevotella pallens
agagtttgatcctggctcaggatgaacgctagctataggcttaacacatgcaagtcgaggggaaacggcattatgtgcttgcacattttggacgtcgaccggcgcacgggtgagtatcgcgtatccaacctgccctttacttggggataccccgttgaaagacggcctaatacccgatgtaattcattgatggcatcagatatgaataaaagatttatcggtaaaggatggggatgcgtctgattagcttgttggtgaggtaaaggctcaccaaggcaacgatcagtaggggttctgagaggaaggtcccccacattggaactgagacacggtccaaactcctacgggaggcagcagtgaggaatattggtcaatgggcgcaagcctgaaccagccaagtagcgtgcaggaagacggccctatgggttgtaaactgcttttatacgagaataatttgatgcacgtgtgcgttattgcatgtatcgtatgaataaggaccggctaattccgtgccagcagccgcggtaatacggaaggtccaggcgttatccggatttattgggtttaaagggagtgtaggcggtttgttaagcgtgttgtgaaatttaggtgctcaacatttaacttgcagcgcgaactgtcagacttgagtacacgcaacgtatgcggaattcatggtgtagcggtgaaatgcttagatatcatgaagaactccgattgcgaaggcagcatacgggagtgtaactgacgcttaagctcgaaggtgcgggtatcgaacaggattagataccctggtagtccgcacagtaaacgatggatgcccgctgttagcgcctggcgttagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagaggaattatttagagataaatatgcccttcggggtctctgtgaaggtgctgcatggttgtcgtcagctcgtgccgtgaggtgtcggcttaagtgccataacgagcgcaaccccttttcttagttgccatcaggtaatgctgggcactctgggaacactgccaccgcaaggtgtgaggaaggtggggatgacgtcaaatcagcacggcccttacgtccggggctacacacgtgttacaatggccggtacagagggatggtgtaatgtaaattgcatcaaatcttaaaagccggtcccagttcggactgaggtctgcaacccgacctcacgaagctggattcgctagtaatcgcgcatcagccatggcgcggtgaatacgttcccgggccttgtacacaccgcccgtcaagccatgaaagccgggggtgcctgaagttcgtaaccgtaaggagcgacctagggcaaaactggtaattggggctaagtcgtaacaaggtagccgtaccggaaggtgcggctggaacacct

SEQ ID NO: 1516 - DNA, 1534 bp, Prevotella ruminicola
ttacaatgaagagtttgatcctggctcaggatgaacgctagctacaggcttaacacatgcaagtcgaggggcatcagatcgaaagcttgcttttgatgctggcgaccggcgcacgggtgagtaacgcgtatccaaccttccctatagtagagaatagcccggcgaaagtcggattaatgctctatgttgtatttagaggacatctgaagaataccaaaggtttaccgctataggatggggatgcgtctgattaggtagtaggcggggtaacggcccacctagccgacgatcagtaggggttctgagaggaaggtcccccacattggaactgagacacggtccaaactcctacgggaggcagcagtgaggaatattggtcaatggacggaagtctgaaccagccaagtagcgtgcaggatgacggccctatgggttgtaaactgcttttatatagggataaagtcggggacgtgtccccgtttgtaggtactatatgaataaggaccggctaattccgtgccagcagccgcggtaatacggaaggtccaggcgttatccggatttattgggtttaaagggagcgcaggctgatgattaagcgtgacgtgaaatgtagccgctcaacggctgaactgcgtcgcgaactggttatcttgagtgagttcgatgttggcggaattcgtggtgtagcggtgaaatgcttagatatcacgaagaactccgattgcgaaggcagccaacaaggcctttactgacgctaaagctcgaaggtgcgggtatcgaacaggattagataccctggtagtccgcacggtaaacgatggatgcccgctgtttgcgatatactgtgagcggccaagagaaatcgttaagcatcccacctggggagtacgccggcaacggtgaaactcaaaggaattgacgggggcccgcacaagcggaggaacatgtggtttaattcgatgatacgcgaggaaccttacccgggcttgaactgccagcgaacgattcagagatgatgaggtccttcgggacgctggtggaggtgctgcatggttgtcgtcagctcgtgccgtgaggtgtcggcttaagtgccataacgagcgcaacccttttctttagttgccatcaggtaatgctgggcactctggagatactgccaccgtaaggtgtgaggaaggtggggatgacgtcaaatcagcacggcccttacgtccggggctacacacgtgttacaatggggggtacagagagtcggatatacgcaagtatgttctaatccttaaagccttcctcagttcggattggggtctgcaacccgaccccatgaagctggattcgctagtaatcgcgcatcagccatggcgcggtgaatacgttcccgggccttgtacacaccgcccgtcaagccatgaaagccgggggcgcttgaagtccgtgaccgcaaggatcggcctagagcgaaactggtaattggggctaagtcgtaacaaggtagccgtaccggaaggtgcggctggaacacctcctttct

SEQ ID NO: 1517 - DNA, 1493 bp, Prevotella salivae
agagtttgatcctggctcaggatgaacgctagctacaggcttaacacatgcaagtcgaggggaaacgacattgaagcttgcttcgatgggcgtcgaccggcgcacgggtgagtaacgcgtatccaacctgcctctgactaagggataacccggcgaaagtcggactaataccttatgaggttttcagcagacatctaacgaaaacgaaagatttatcggtcagtgatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttatgtggggataaagtgagctacgtgtagtttattgcaggtaccacatgaataaggaccggctaattccgtgccagcagccgcggtaatacggaaggtccaggcgttatccggatttattgggtttaaagggagcgtaggccgtggattaagcgtgttgtgaaatgtagacgctcaacgtctgaattgcagcgcgaactggttcacttgagtatgcacaacgtaggcggaattcgtcgtgtagcggtgaaatgcttagatatgacgaagaactccgattgcgaaggcagcttacgggagcacaactgacgctgaagctcgaaggtgcgggtatcaaacaggattagataccctggtagtccgcacagtaaacgatggatgcccgttgttagttcacttatgaattagcgaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagacgaacgattcagagatgatgaggcccttcggggcgtctgtgaaggtgctgcatggttgtcgtcagctcgtgccgtgaggtgtcggcttaagtgccataacgagcgcaaccccttttttcagttgccatcaggtgatgctgggcactctggagatactgccaccgtaaggtgtgaggaaggtggggatgacgtcaaatcagcacggcccttacgtccggggctacacacgtgttacaatggccggtacagagcgttggtcgtgtgcaaatacgatctaatccttaaagccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtctgtgaccgcaaggaacggcctagggcaaaactggtgattggggctaagtcgtaacaaggtaacc

SEQ ID NO: 1518 - DNA, 1327 bp, Prevotella sp.
  BI-42
  modified_base (529)..(529): a, c, t, g, unknown or other
tgagtttgatcctggctcaggatgaacgctagctacaggcttaacacatgcaagtcgagggaccggcgcacgggtgagtaacgcgtatccaacctgcccaccacttggggataaccttgcgaaagtaagactaatacccaatgattaaagtcggtgatggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatggacgagagtctgaaccagccaagtagcgtgcaggatgacggcctatgggttgtaaactgcttttataagggaatatgcatgtaccttatgaataaggaccggctaattccgtgccagcagccgcggtaatacggaaggtccgggcgttatccggatttattgggtttaaagggagcgtaggccggagattaagcgtgttgtgaaatgtagacgctcaacntctgcactgcagcgcgaactggtttccttgagtacgcacaaagtgggcggaattcgtggtgtagcggtgaaatgcttagatatcacgaagaactccgattgcgaaggcagctcactggagcgactgacgctgaagctcgaaagtgcgggtatcgaacaggattagataccctggtagtccgcacggtaaacgatggatgcccgctgttggtcggtcagcggccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggatgtcgtcagctcgtgccgtgaggtgtcggcttaagtgccataacgagcgcaacccctctccttagttgccatcagctgggcactctggggacactgccaccgtaaggtggaggaaggtggggatgacgtcaaatcagcacggcccttacgtccggggctacacacgtgttacaatggcaggcagagagacggtcccttgcaaaatggatcaaatccttcctgtctcagttcggatggggtctgcaacccgaccccagaagctggattcgctagtaatcgcgcatcagccatggcgcggtgaatacgtcccgggccttgtacacaccgcccgtcaagccatgaaagccgggggcgcctaaagtccgtgcggcctagggcgaaactggtaattggggctaagtcgtaacaaggtagccgt

SEQ ID NO: 1519 - DNA, 1459 bp, Prevotella sp.
  CM38
ctcaggatgaacgctagctacaggcttaacacatgcaagtcgcggggcagcatgggggttgcttgcaacccctgatggcgaccggcgcacgggtgagtaacgcgtatccaacctgcccttcaccacgggataacccggcgaaagtcggactaataccgtatgttgtccattgacggcatccgatttggacgaaaggcttagcggtgagggatggggatgcgtccgattagctcgacggcggggtaacggcccaccgtggcaacgatcggtaggggttctgagaggaaggtcccccacactggaactgagacacggtccagactcctacgggaggcagcagtgaggaatattggtcaatgggcggaagcctgaaccagccaagtagcgtgcaggatgacggccctatgggttgtaaactgcttttatgcggggataaaggggcccacgtgtgggtttttgcaggtaccgcatgaataaggaccggctaattccgtgccagcagccgcggtaatacggaaggtccgggcgttatccggatttattgggtttaaagggagcgtaggccgccccttaagcgtgttgtgaaatgcgggtgctcaacatccgacttgcagcgcgaactggggggcttgagtgcgccgaaagtaggcggaattcgtggtgtagcggtgaaatgcttagatatcacgaagaactccgattgcgaaggcagcttactgtagcgcaactgacgctgatgctcgaaagcgtgggtatcgaacaggattagataccctggtagtccacgcggtaaacgatggatgctcgttgtcggcctttgaggccggtgaccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggcggaacgattccgagaggatgaggcccttcggggctgccgcggaggtgctgcatggttgtcgtcagctcgtgccgtgaggtgtcggcttaagtgccataacgagcgcaacccccgtcttcagttgccatcggatgatgccgggcactctggagatactgccaccgcaaggtgtgaggaaggtggggatgacgtcaaatcagcacggcccttacgtccggggctacacacgtgttacaatggcgcatacagagagtaggtggcatgcgagtgccatccaatccttaaagtgcgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctgaagtccgtgaccgcgagggtcggcctagggtgaaaccggtgattggggctaag

SEQ ID NO: 1520 - DNA, 1452 bp, Prevotella sp.
  ICM1
aggatgaacgctagctacaggcttaacacatgcaagtcgaggggaaacggcattgagtgcttgcactctttggacgtcgaccggcgcacgggtgagtaacgcgtatccaaccttcccattactgtgggataacctgccgaaaggcagactaataccgcatagtcttcgatgacggcatcagatttgaagtaaagatttatcggtaatggatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatggacggaagtctgaaccagccaagtagcgtgcaggatgacggccctatgggttgtaaactgcttttgtatggggataaagttagggacgtgtccctatttgcaggtaccatacgaataaggaccggctaattccgtgccagcagccgcggtaatacggaaggtccaggcgttatccggatttattgggtttaaagggagcgtaggctggagattaagtgtgttgtgaaatgtagacgctcaacgtctgaattgcagcgcatactggttttcttgagtacgcacaacgttggcggaattcgtcgtgtagcggtgaaatgcttagatatgacgaagaactccgattgcgaaggcagctgacgggagcgcaactgacgcttaagctcgaaggtgcgggtatcaaacaggattagataccctggtagtccgcacagtaaacgatggatgcccgctgttggtacctggtatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagaggaaggatttagagataatgacgcccttcggggcctctgtgaaggtgctgcatggttgtcgtcagctcgtgccgtgaggtgtcggcttaagtgccataacgagcgcaacccctctcttcagttgccatcaggttaagctgggcactctggagacactgccaccgtaaggtgtgaggaaggtggggatgacgtcaaatcagcacggcccttacgtccggggctacacacgtgttacaatggccggtacagagggatggtgtaatgcaaattgcatcaaatcttgaaagccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccgcaaggatcggcctagggcaaactggtgattgggg

SEQ ID NO: 1521 - DNA, 1458 bp, Prevotella sp.
  ICM55
acgctagctacaggcttaacacatgcaagtcgaggggaaacgacattgaagcttgcttcgatgggcgtcgaccggcgcacgggtgagtaacgcgtatccaacctgcctctgactaagggataacccggcgaaagtcggactaataccttatgaggttttcagcagacatctaatgaaaacgaaagatttatcggtcagtgatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttatgtggggataaagtgagctacgtgtagtttattgcaggtaccacatgaataaggaccggctaattccgtgccagcagccgcggtaatacggaaggtccaggcgttatccggatttattgggtttaaagggagcgtaggccgtggattaagcgtgttgtgaaatgtagacgctcaacgtctgaattgcagcgcgaactggttcacttgagtatgcacaacgtaggcggaattcgtcgtgtagcggtgaaatgcttagatatgacgaagaactccgattgcgaaggcagcttacgggagcacaactgacgctgaagctcgaaggtgcgggtatcaaacaggattagataccctggtagtccgcacagtaaacgatggatgcccgttgttagttcacttaagaattagcgaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagacgaacgattcagagatgatgaggcccttcggggcgtctgtgaaggtgctgcatggttgtcgtcagctcgtgccgtgaggtgtcggcttaagtgccataacgagcgcaaccccttttttcagttgccatcaggtgatgctgggcactctggagatactgccaccgtaaggtgtgaggaaggtggggatgacgtcaaatcagcacggcccttacgtccggggctacacacgtgttacaatggccggtacagagcgttggttgtatgcaaatacgatctaatccttaaagccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtctgtgaccgcaaggaaacggcctagggcaaaactggtgattggggctaagtcgta

SEQ ID NO: 1522 - DNA, 1479 bp, Prevotella sp.
  JCM 6330
ggctcaggatgaacgctagctacaggcttaacacatgcaagtcgaggggaaacggcgtttagtgcttgcactgttcggacgtcgaccggcgcacgggtgagtaacgcgtatccaaccttcccataactaagggataacctgccgaaaggcagactaataccttatgtaattcttagatgacatcagaagagaatgaaagatttatcggttatggatggggatgcgtctgattagcttgttggcggggtaacagcccaccaaggcgacgatcagtaggggttctgagaggaaggtcccccacattggaactgagacacggtccaaactcctacgggaggcagcagtgaggaatattggtcaatgggcgagagcctgaaccagccaagtagcgtgcaggaagacggccctatgggttgtaaactgcttttgtatggggataaagtcaatcacgtgtgattgtttgcaggtaccatacgaataaggaccggctaattccgtgccagcagccgcggtaatacggaaggttcgggcgttatccggatttattgggtttaaagggagcgtaggccggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgccactgacgcttaagctcgaaggtgcgggtatcgaacaggattagataccctggtagtccgcacagtaaacgatggatgcccgctgttggtacctggtatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagaggaaggatttagagataatgacgcccttcggggtctctgtgaaggtgctgcatggttgtcgtcagctcgtgccgtgaggtgtcggcttaagtgccataacgagcgcaacccctctcttcagttgccatcaggtaatgctgggcactctggagacactgccaccgtaaggtgtgaggaaggtggggatgacgtcaaatcagcacggcccttacgtccggggctacacacgtgttacaatggccggtacagagggacggtgtaatgcaaattgcatccaatcttgaaagccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccggaaggatcggcctagggcaaaactggtgattggggctaagtcgtaacaaggtaacc

SEQ ID NO: 1523 - DNA, 1374 bp, Prevotella sp.
  SEQ053
tgcaagtcgcggggcagcatgagggttgcttgcaacctttgatggcgaccggcgcacgggtgagtaacacgtatccaacctactccttacaacggaataacccggcgaaagtcggactaataccgtatgatatcctatgcaggcatctaaytaggattaaaggtttagcggtaagggatggggatgcgtctgattaggcagttggcggggtaacggcccaccaaaccgacgatcagtaggggttctgagaggaaggtcccccacattggaactgagacacggtccaaactcctacgggaggcagcagtgaggaatattggtcaatggacggaagtctgaaccagccaagtagcgtgcaggatgacggccctatgggttgtaaactgcttttatacggggataaagttagggacgtgtccctatttgcaggtaccgtatgaataaggaccggctaattccgtgccagcagccgcggtaatacggaaggtccgggcgttatccggatttattgggtttaaagggagcgtaggccgtagattaagtgtgttgtgaaatgtagacgctcaacgtctgacttgcagcgcatactggtttacttgagtttgcacaacgttggcggaattcgtcgtgtagcggtgaaatgcttagatatgacgaagaactccgattgcgaaggcagcttgcgggagcaaaactgacgctgaagctcgaaagtgcgggtatcgaacaggattagataccctggtagtccgcacggtaaacgatggatgcccgttgtatggcctttcggctatgtgaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaactgtaggygaacgatctagagatagtgaggcccttcggggcgcctacggaggtgctgcatggttgtcgtcagctcgtgccgtgaggtgtcggcttaagtgccataacgagcgcaacccctgttctcagttgccatcgggtgatgccgggcactctgaggatactgcctccgcaaggagtgaggaaggtggggatgacgtcaaatcagcacggcccttacgtccggggctacacacgtgttacaatggccggtacagagcgtcggtcgtatgcaaatacgatctaatctttaaaaccggtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctg

SEQ ID NO: 1524 - DNA, 1227 bp, Prevotella sp.
  SEQ065
agtcgagggaccggcgcacgggtgagtaacgcgtatccaacctwcccattactgtgggataacctgccgaaaggcagactaataccgcatrgttaaagtcggtaatggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatggacgagagtctgaaccagccaagtagcgtgcaggatgacggcctatgggttgtaaactgcttttgtatggggatatgcaggtaccatacgaataaggaccggctaattccgtgccagcagccgcggtaatacggaaggtccgggcgttatccggatttattgggtttaaagggagcgtaggcyggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgactgacgcttaagctcgaaggtgcgggtatcgaacaggattagataccctggtagtccgcacagtaaacgatggatgcccgctgttggtatatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctctcttcagttgccatcagctgggcactctggagacactgccaccgtaaggtggaggaaggtggggatgacgtcaaatcagcacggcccttacgtccggggctacacacgtgttacaatggccggcagagggatggtgtaatgcaaattgcatcaaatcttgccggtcccagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgtacc

SEQ ID NO: 1525 - DNA, 1273 bp, Prevotella sp.
  SEQ072
tgatcctggctcaggatgaacgctagctacaggcttaacacatgcaagtcgcgggaccggcgcacgggtgagtaacgcgtatccaaccttcccattactacggcataccccgttgaaaggcggcctaattccgtatgcagaaagtcggtaatggatggggatgcgtccgattagccagtcggcggggtaacggcccaccgaggcatcgatcggtaggggttctgagaggaaggtcccccacactggaactgagacacggtccagactcctacgggaggcagcagtgaggaatattggtcaatgggcgtaagcctgaaccagccaagtagcgtgcaggatgacggcctatgggttgtaaactgcttttatgcggggatatgcaggtaccgcatgaataaggaccggctaattccgtgccagcagccgcggtaatacggaaggtccgggcgttatccggatttattgggtttaaagggagcgtaggcagttttttaagcgtgctgtgaaatgtaccggctcaaccggtgatgtgcagcgcgaactgggaatcttgagtacgcagtaagcaggcggaattcgtggtgtagcggtgaaatgcttagatatcacgaagaactccgattgcgtaggcagcttgctgtagcgactgacgctgaagctcgaaagtgcgggtatcgaacaggattagataccctggtagtccgcacggtaaacgatggatgcccgctgtcggtcggtcggtggccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgtggaggtgctgcatggttgtcgtcagctcgtgccgtgaggtgtcggcttaagtgccataacgagcgcaaccccttttttcagttgccatcggccgggcactctgtgaatactgccgccgtaaggtggaggaaggtggggatgacgtcaaatcagcacggcccttacgtccggggstacacacgtgttacaatggcgcgcagcgagtcggccgtatgtaaatacggtccaatccttcgcgcctcagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgtacc

SEQ ID NO: 1526 - DNA, 1274 bp, Prevotella sp.
  SEQ116
ttgatcctggctcaggatgaacgctagctacaggcttaacacatgcaagtcgagggaccggcgcacgggtgagtaacgcgtatccaactttcccattactgtggaataacctgccgaaaggcagactaataccgcatagttaaagtcggtaatggatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatgggcgagagcctgaaccagccaagtagcgtgcaggatgacggcctatgggttgtaaactgcttttgtatggggatatgcaggtaccatacgaataaggaccggctaattccgtgccagcagccgcggtaatacggaaggtccaggcgttatccggatttattgggtttaaagggagcgtaggccggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgactgacgcttaagctcgaaggtgcgggtatcaaacaggattagataccctggtagtccgcacagtaaacgatggatgcccgctgttggtatatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctctcttcagttgccatcagctgggcactctggagacactgccaccgtaaggtggaggaaggtggggatgacgtcaaatcagcacggcccttacgtccggggctacacacgtgttacaatggccggcagagggacggtgtaatgcaaattgcatccaatcttgccggtcccagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgtacc

SEQ ID NO: 1527 - DNA, 1340 bp, Prevotella sp.
  SG12
cccctgatggcgaccggcgcacgggtgagtaacgcgtatccaacctgcccttcaccacgggataacccggcgaaagtcggactaataccgtatgttgtccattgacggcatccgatttggacgaaaggcttagcggtgagggatggggatgcgtccgattagcttgacggcggggtaacggcccaccgtggcaacgatcggtaggggttctgagaggaaggtcccccacactggaactgagacacggtccagactcctacgggaggcagcagtgaggaatattggtcaatgggcggaagcctgaaccagccaagtagcgtgcaggatgacggccctatgggttgtaaactgcttttatgcggggataaaggggcccacgtgtgggtttttgcaggtaccgcatgaataaggaccggctaattccgtgccagcagccgcggtaatacggaaggtccgggcgttatccgggatttattgggtttaaagggagcgtaggccgccccttaagcgtgttgtgaaatgcgggtgctcaacatccgacttgcagcgcgaactggggggcttgagtgcgccgaaagtaggcggaattcgtggtgtagcggtgaaatgcttagatatcacgaagaactccgattgcgaaggcagcttactgtagcgcaactgacgctgatgctcgaaagcgtgggtatcgaacaggattagataccctggtagtccacgcggtaaacgatggatgctcgttgtcggcctttatggtcggtgaccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggcggaacgattccgagaggatgaggcccttcggggctgccgcggaggtgctgcatggttgtcgtcagctcgtgccgtgaggtgtcggcttaagtgccataacgagcgcaacccccgtcttcagttgccatcgggttatgctgggcactctggagatactgccaccgcaaggtgtgaggaaggtggggacgacgtcaaatcagcacggcccttacgtccggggctacacacgtgttacaatggcgcatacagagagtaggtggcatgcgaatgccatccaatccttaaagtgcgtctcagttcggactggggtctgcaacccgaccccacgaagctggattcgctagtaatcgcgcatcagccatggcgcggtgaatacgttcccgggccttgtacacaccgcccgtcaagccatgaaagccgggggggcggcc

SEQ ID NO: 1528 - DNA, 1451 bp, Prevotella sp.
  oral clone AA020
ttcaggatgaacgctagctacaggcttaacacrtgcaagtcgaggggaaacgacggggaagcttgcttctccggtcgtcgaccggcgcacgggtgagtaacgcgtatccaacctgcctctgaccaagggataacccgtcgaaagtcggactaataccttatgcagtcgtcggaagtcatctgatgacgacgaaagatttcatcggtgagagatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatggacgagagtctgaaccagccaagtagcgtgcaggatgacggccctatgggttgtaaactgcttttatgcggggataaagtgagggacgtgtccttcattgcaggtaccgcatgaataaggaccggctaattccgtgccagcagccgcggtaatacggaaggtccgggcgttatccggatttattgggtttaaagggagcgtaggccgtggattaagcgtgttgtgaaatgtagacgctcaacgtctgacttgcagcgcgaactggtccacttgagtgtgcacaacgcaggcggaattcgtcgtgtagcggtgaaatgcttagatatgacgaagaaccccgattgcgaaggcagcttgcgggagcacgactgacgctgaagctcgaaagtgcgggtatcgaacaggattagataccctggtagtccgcacggtaaacgatggatgcccgttatcaggctttttagtctggtgaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagacgtacgattcagagatgaagaggcccttcggggcgtctgtgaaggtgctgcatggttgtcgtcagctcgtgccgtgaggtgtcggcttaagtgccataacgagcgcaacccctattctcggttgccatcgggtaatgccgggcactccgtggagactgccaccgtaagtgtgaggaagtggggacgacgtcaaatcagcacggsccttacgtccggggctacacacgtgttacaatggccggtacagcgagtcggccgcatgcaaatgcggtccaatcctgaaagccggtcccagttcggaccggggtctgcaacccgaccccgcgaagccggattcgctagtaatcgcgcatcagccatggcgcggtgaatacgttcccgggccttgtacacaccgcccgtcaagccatgaaagccgggggtgcctgaagtccgttaccgcgagggtcggcctaaggcaaaaccggtgattg

SEQ ID NO: 1529 - DNA, 1365 bp, Prevotella sp.
  oral clone ASCG10
  modified_base (1)..(1): a, c, t, g, unknown or other
  modified_base (259)..(259): a, c, t, g, unknown or other
ngagtttgatcttggctcaggatgaacgctagctacaggcttaacacatgcaagtcgagggaccggcgcacgggtgcgtaacgcgtatcaaacctgcctcatactcggggatagccttgcgaaagtaagattaatacccgatgttcaaagtcggtatgagatggtgatgcgtccgattaggtagtaggcggggtaacggcccacctagccttcgatcggtaggggttctgagaggaaggtcccccacactgtaactganacacggtccagactcctacgggaggcagcagtgaggaatattggtcaatggacgcaagtctgaaccagccaagtagcgtgaaggatgacggcctctgggttgtaaactgcttttagttgggaatatgtatgtaccttcagaaaaaggaccggctaattccgtgccagcagccgcggtaatacggaaggtccaggcgttatccggatttattgggtttaaagggagcgtaggcggattattaagtcagtggtgaaagacggtggctcaaccatcgttagccattgatactggtagtcttgagtgcagcaggggatgctggaactcgtggtgtagcggtgaaatgcttagatatcacgatgaactccgatcgcgaaggcaggtgtccgggctgactgacgctgaggctcgaaagtgtgggtatcaaacaggattagataccctggtagtccacacagtaaacgatgtatactcgcggtttgcgagtaagccgccaagcgaaagcattaagtataccacctggggagtacgccggcaacggtgaaactcaaaggaattgacgggggcccgcacaagcggaggaacatgtggtttaattcgatgatacgcgaggaaccttacccgggcttgaactatggaggtgctgcatggttgtcgtcagctcgtgccgtgaggtgtcggcttaagtgccataacgagcgcaaccctttttcttggttgccatcagctgggcactccagggatactgccatcgtaagatggaggaaggtggggatgacgtcaaatcagcacggcccttacgtccggggctacacacgtgttacaatggggggcagaaggtcgctacctggtgacaggatgctaatctcacctctctcagttcggatggagtctgcaacccgactccagaagctggattcgctagtaatcgcgcatcagccatggcgcggtgaatacgttcccgggccttgtacacaccgcccgtcacaccacgaaagtcggaagtacccaaagccggtgggtagccagccgtctaaggtaaagtcgatgattggggtgaagtcgtaacaaggtagccgtatcggaaggtgcggctggaacacctcctt

SEQ ID NO: 1530 - DNA, 1319 bp, Prevotella sp.
  oral clone ASCG12
  modified_base (334)..(334): a, c, t, g, unknown or other
gagtttgatcttggctcaggatgaacgctagctacaggcttaacacatgcaagtcgcgggaccggcgcacgggtgagtaacgcttatccaacctgcccttcaccacgggataacccggcgaaagtcggactaataccgtatgttgaaaggcggtgaaggatggggatgcgtccgattagctggacggcggggtaacggcccaccgtggcaacgatcggtaggggttctgagaggaaggtcccccacactggaactgagacacggtccagactcctacgggaggcagcagtgaggaatattggtcaatgggcgtaagcctgaaccagccaagtancgtgcaggatgacggccttatggttgtaaactgcttttatgcggggatatgcaggtaccgcatgaataaggaccggctaattccgtgccagcagccgcggtaatacggaaggtccgggcgttatccggatttattgggtttaaagggagcgtaggccgcgccttaagcgtgttgtgaaatccggttgctcaacatccggcttgcagcgcgaactggggcgcttgagtgcgcagaaagtaggcggaattcgtggtgtagcagtgaaatgcttagatatcacgaggaactccgattgcgaaggcagcctactgtagcgactgacgctgatgctcgaaagcgtgggtatcgaacaggattagataccctggtagtccacgcggtaaacgatggatgctcgttgtcggccggtcggtgaccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggaggtgctgcatggttgtcgtcagctcgtgccgtgaggtgtcggcttaagtgccataacgagcgcaacccccgtcttcagttgccatcggccgggcactctggagatactgccaccgcaaggtggaggaaggtggggatgacgtcaaatgagcacggcccttacgtgggctacacacgtgctacaatggcgtacagagggcgacgaagccgcgaggtggagtgaatctcagtacgtctaagtccggatggagtctgcaacccgaccccagaagctggattcgctagtaatcgcgcatcagccatggcgcggtgaatacgttcccgggccttgtacacaccgcccgtcaagccatgaaagccgggggcgcctgaagtccgtgtcggcctagggtgaaaccggtgattggggctaagtcgtaacaagg

SEQ ID NO: 1531 - DNA, 1470 bp, Prevotella sp.
  oral clone AU069
agagtttgatcatggctcaggatgaacgctagctacaggcctaacacatgcaagtcgtggggcagcgggtatgcttgttttcaagtatatgccggcgaccggcgcacgggtgagtaacgcgtatccaacctgcccatcacaagggaataacccgtcgaaagtcggcctaatgccctatgtattccgatgaagtcctctgaatcggaataaagcatttgcggtgatggatggggatgcgtctgattagcttgtcggcggggtaacggcccaccgaggcaacgatcagtaggggttctgagaggaaggtcccccacattggaactgagacacggtccaaactcctacgggaggcagcagtgaggaatattggtcaatgggcgtgagcctgaaccagccaagtagcgtgcaggatgacggccctatgggttgtaaactgcttttatacggggataaagtgagggacgcgtccctttttgcaggtaccgtatgaataaggaccggctaattccgtgccagcagccgcggtaatacggaaggtcctggcgttatccggatttattgggtttaaagggagcgcaggctgcactttaagcgtgttgtgaaatgtaccggctcaaccggtaacgtgcagcgcgaactggggtgcttgagtacgaagagggaaggcggaactcgtggtgtagcggtgaaatgcttagatatcacgaggaactccgatcgcgaaggcagctttccgtttcggaactgacgctgaggctcgaaagtgcgggtatcgaacaggattaggtaccctggtagtccgcacggtaaacgatggatgcccgctgtcggcgccttgcgccggcggccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaatcgcaggaagaacgatacagagatgttgaggtccttcgggactcctgcgaaggtgctgcatggttgtcgtcagctcgtgccgtgaggtgtcggcttaagtgccataacgagcgcaacccctctccccagttgccatcgggtgatgccgggcacttcggggacactgccgccgcaaggtgcgaagaaggccgggatgacgtcaaatcagcacggcccttacgtccggggctacacacgtgttacaatggccggcacagaaggccggtgcggcgcgagccgcatctaatcttgaaaaccggtcttagttcggactggggtctgcaacccgaccccacgaagctggattcgctagtaatcgcgcatcagccacggcgcggtgaatacgttcccgggccttgtacacaccgcccgtcaagccatgaaagccgggggtgcctgaagtccgtgaccgcgaggatcggcctagggcaaaactggtgattgg

SEQ ID NO: 1532 - DNA, 1446 bp, Prevotella sp.
  oral clone CY006
gagtttgattctggctcaggatgaacgctagctacaggcctaacacatgcgagtcgtggggcagcgggtatgcttgttttcaagtatatgccggcgaccggcgcacgggtgagtaacgcgtatccaacctgcccatcacaagggaataacccgtcgaaagtcggcctaatgccctatgtattccgatgaagtcctctgaatcggaataaagcatttgcggtgatggatggggatgcgtctgattagcttgtcggcggggtaacggcccaccgaggcaacgatcagtaggggttctgagaggaaggtcccccacattggaactgagacacggtccaaactcctacgggaggcagcagtgaggaatattggtcaatgggcgtgagcctgaaccagccaagtagcgtgcaggatgacggccctatgggttgtaaactgcttttatacggggataaaagggtgaacgtgttctcctttgcaggtaccgtatgaataaggaccggctaattccgtgccagcagccgcggtaatacggaaggtcctggcgttatccgggtttattgggtttaaagggagcgcaggctgcactttaagcgtgttgttaaatgtgccggctcaaccggtaacgtgcagcgcgaactggggtgcttgagcacgaagagggaaggcggaactcgtggtgtagcggtgaaatgcttagatatcattaggaactccgatcgcgaaggcagctttccgtttcggaactgacgctgaggctcgaaagtgcgggtatcgaacaggattagataccctggtagtccgcacggtaaacgatggatgctcgctgttggatatttttattcagtggctaagtgaaaacgttaagcatcccacctggggagtacgccggcaacggtgaaactcaaaggaattgacgggggcccgcacaagcggaggaacatgtggtttaattcgatgatacgcgaggaaccttacccgggcttgaattgcagctgaacgatccagagatggtgaggcccttcggggcagctgtgaaggtgctgcatggttgtcgtcagctcgtgccgtgaggtgtcggcttaagtgccataacgagcgcaacccctctccgcagttgccatcggttgatgccgggcactctgcggacactgcctccgcaaggagtgaggaaggtggggatgacgtcaaatcagcacggcccttacgtccggggctacacacgtgttacaatggcgcgtacagagtgtcggtgctgtgcaaacagtatctaaccaataaaacgcgtcccagttcggaccggggtctgcaacccgaccccgcgaactggattcgctagtaatcgcgcatcagccatggcgcggtgaatacgttcccgggccttgtacacaccgcccgtcaagccatgaaagccgmgggcgcctgaagtccgtgaccgcaaggatcggc

SEQ ID NO: 1533 - DNA, 1524 bp, Prevotella sp.
  oral clone DA058
gagtttgatyctggctcaggatgaacgctagctacaggcttaacccatgcaagtcgaggggcatcaaattggttgcttgcaaccgatgttgscgaccggcgcacgggtgagtaacgcgtatccaaccttccctttactctggtatagcccagcgaaagttggattaataccggatgttatcgaaagctctcatgagactttgatcaaagattttatcggtaaaggatggggatgcgtctgattaggcagttggcggggtaacggcccaccaaaccgacgatcagtaggggttctgagaggaaggtcccccacattggaactgagacacggtccaaactcctacgggaggcagcagtgaggaatattggtcaatggacgtaagtctgaaccagccaagtagcgtgcaggatgactgccctatgggttgtaaactgcttttatgcggggataaagtcagccacgtgtggttgtttgcaggtaccgcatgaataaggaccggctaattccgtgccagcagccgcggtaatacggaaggtccgggcgttatccggatttattgggtttaaagggagcgtaggctgttggttaagcgtgttgtgaaatgtagatgctcaacatctgaattgcagcgcgaactgtccgacttgagtgcgcggaaagcaggcggaattcgttgtgtagcggtgaaatgcttagatatgacgaagaactccgattgcgaaggcagcttgctgtagcgtaactgacgctgaagctcgaaagtgcgggtatcgaacaggattagataccctggtagtccgcacggtaaacgatggatgctcgctgtgtgcttatttttagtatgcggctaagggaaaccattaagcatcccacctggggagtacgccggcaacggtgaaactcaaaggaattgacgggggcccgcacaagcggaggaacatgtggtttaattcgatgatacgcgaggaaccttacccgggcttgaactgccggtgctggcatgagagatcatgctttccttcgggacactggtggaggtgctgcatggttgtcgtcagctcgtgccgtgaggtgtcggcttaagtgccataacgagcgcaacccctgtcgtcagttgccatcaggtaatgctgggcactctggtgatactgccaccgtaaggtgtgaggaaggtggggatgacgtcaaatcagcacggcccttacgtccggggctacacacgtgttacaatggcgtgtacagcgagtcggtaccgggcaaccggtatccaatcaatataacacgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcttgaagtccgtgaccgcaaggatcggcctagagcgaaactggtaattggggctaagtcgtaacaaggtagccgtaccggaaggtgcggctggaacacctccttc

SEQ ID NO: 1534 - DNA, 1356 bp, Prevotella sp.
  oral clone FL019
gagtttgattctggctcaggatgaacgctagctacaggcctaacacatgcaagtcgtgggaccggcgcacgggtgagtaacgcgtatccaacctgcccatcacaagggaataacccgtcgaaagtcggcctaatgccctatgtgtaaaggcggtgatggatggggatgcgtctgattagcttgtcggcggggtaacggcccaccgaggcgacgatcagtaggggttctgagaggaaggtcccccacattggaactgagacacggtccaaactcctacgggaggcagcagtgaggaatattggtcaatgggcgtgagcctgaaccagccaagtagcgtgcaggatgacggcctatgggttgtaaactgcttttatacggggatatgcaggtaccgtatgaataaggaccggctaattccgtgccagcagccgcggtaatacggaaggtcctggcgttatccggatttattgggtttaaagggagcgcaggctgcactttaagcgtgttgtgaaatgtaccggctcaaccggtaacgtgcagcgcgaactggggtgcttgagtacgaagagggaaagcggaactcgtggtgtagcggtgaaatgcttagatatcacgaggaactccgatcgcgaaggcagctttccgtttcgactgacgctgaggctcgaaagtgcgggtatcgaacagggttagataccctggtagtccgcacggtaaacgatggatgctcgctgttggatattcagtggctaagtgaaaacgttaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctctccgcagttgccatcggccgggcactctgcggacactgcctccgcaaggaggaggaaggtggggatgacgtcaaatcagcacggcccttacgtccggggctacacacgtgttacaatggcgcgcagagtgtcggtgctgtgcaaacagtatctaatcaatcgcgtcccagttcggacggggtctgcaacccgaccccggaagctggattcgctagtaatcgcgcatcagccatggcgcggtgaatacgttcccgggccttgtacacaccgcccgtcaagccatgaaagccgggggcgcctgaagtccgttcggcctagggcgagaccggtgattggggctaagtcgtaacaaggtagccgtaccggaaggtgcggctggatcacctcctt

SEQ ID NO: 1535 - DNA, 1356 bp, Prevotella sp.
  oral clone FU048
gagtttgattctggctcaggatgaacgctagctacaggcttaacacatgcaagtcgagggaccggcgcacgggtgagtaacgcgtatccaaccttcccattactgtggaataacctgccgaaaggcagactaataccgcatggttaaagtcggtaatggatggggatgcgtctgattagcttgttggcggggtaacggcccaccaaggcgacgatcagtaggggttctgagaggaaggtcccccacatcggaactgagacacggtccaaactcctacgggaggcagcagtgaggaatattggtcaatggacgtaagtctgaaccagccaagtagcgtgcaggatgacggcctatgggttgtaaactgcttttgtatggggatatgcaggtaccatacgaataaggaccggctaattccgtgccagcagccgcggtaatacggaaggtccaggcgttatccggatttattgggtttaaagggagcgtaggccggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgactgacgcttaagctcgaaggtgcgggtatcaaacaggattagataccctggtagtccgcacagtaaacgatggatgcccgctgttggtatatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctctcttcagttgccatcagctgggcactctggagacactgccaccgtaaggtggaggaaggtggggatgacgtcaaatcagcacggcccttacgtccggggctacacacgtgttacaatggccggcagagggacggtgtaatgcaaattgcatccaatcttgccggtcccagttcggatggggtctgcaacccgaccccagaagctggattcgctagtaatcgcgcatcagccatggcgcggtgaatacgttcccgggtcttgtacacaccgcccgtcaagccatgaaagccgggggtgcctgaagtccgttcggcctagggcaaaactggtgattggggctaagtcgtaacaaggtagccgtaccggaaggtgcggttggatcacctcctt

SEQ ID NO: 1536 - DNA, 1354 bp, Prevotella sp.
  oral clone FW035
gagtttgatcctggctcaggatgaacgctagctacaggcttaacacatgcaagtcgagggaccggcgaatgggtgagtaacgcgtatccaacctgcccccggctggggtataacccgtcgaaaggcggcctaatcccccatggttaaagccggccggggatggggatgcgtccgattagcttgctggtgaggtaacggctcaccagggcatcgatcggtaggggttctgagaggaaggtcccccacactggtactgagacacggaccagactcctacgggaggcagcagtgaggaatattggtcaatgggcgcaagcctgaaccagccaagtagcgtgcaggatgaaggcctatgggtcgtaatctgcttttatgtggggatatgcaggtaccacatgaataaggaccggctaattccgtgccagcagccgcggtaatacggaaggtccgggcgttatccggatttattgggtttaaagggagcgtaggccgcctcttaagcgtgttgtgaaaaccgggcgctcaccgtccggcttgcagcgcgaactggggggcttgagtgcgtgcgacgccggcggaattcgtcgtgtagcggtgaaatgcttagatatgacgaggaactccgattgcgaaggcagctggcgagtgcgactgacgctaatgctcgaaggcgcgggtatcgaacaggattagataccctggtagtccgcgctgtaaacgatggatgcccgccgtgggtatttccgcggccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaattgcgaaggtgctgcatggttgtcgtcagctcgtgccgtgaggtgtcggcttaagtgccataacgagcgcaacccctctccgcagttgccatcggccgggcactctgcggacactgccgccgcaaggtggaggaaggtggggatgacgtcaaatcagcacggcccttacgtccggggctacacacgtgttacaatggccggcagagagttgcgcgcgcaagcgttgccaatccctccggcctcagttcggatggggtctgcaacccgaccccagaagctggattcgctagtaatcgcgcatcagccatggcgcggtgaatacgttcccgggccttgtacacaccgcccgtcaagccatgaaagctgggggcgcctgaagtccgtgtcggcctagggcgaaaccggtgattggggctaagtcgtaacaaggtagccgtaccggaaggtgcggctggatcacctcctt

SEQ ID NO: 1537 - DNA, 1356 bp, Prevotella sp.
  oral clone GI030
gagtttgattctggctcaggatgaacgctagctacaggcttaacacatgcaagtcgagggaccggcgcacgggtgagtaacgcgtatccaacctacccattactgtgggataacctgccgaaaggcagactaataccgcatggttaaagtcggtaatggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatggacggaagtctgaaccagccaagtagcgtgcaggatgacggcctatgggttgtaaactgcttttgtatggggatatgcaggtaccatacgaataaggaccggctaattccgtgccagcagccgcggtaatacggaaggtccaggcgttatccggatttattgggtttaaagggagcgtaggccggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgactgacgcttaagctcgaaggtgcgggtatcgaacaggattagataccctggtagtccgcacagtaaacgatggatgcccgctgttggtatatcagcggctaagcgaaagcattaagcatcccacctggggagtacgccggcaacggtgaaactcaaaggaattgacgggggcctgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctctcttcagttgccatcagctgggcactctggagacactgccaccgtaaggtggaggaaggtggggatgacgtcaaatcagcacggcccttacgtccggggctacacacgtgttacaatggccggcagagggatggtgtaatgcaaattgcatcaaatcttgccggtcccagttcggatggggtctgcaacccgaccccagaagctggattcgctagtaatcgcgcatcagccatggcgcggtgaatacgttcccgggccttgtacacaccacccgtcaagccatgaaagccgggggtgcctgaagtccgttcggcctagggcaaaactggtgattggggctaagtcgtaacaaggtagccgtaccggaaggtgcggctggatcacctcctt

SEQ ID NO: 1538 - DNA, 1356 bp, Prevotella sp.
  oral clone GI032
gagtttgatcctggctcaggatgaacgctagctacaggcttaacacatgcaagtcgagggaccggcgcacgggtgagtaacgcgtatccaacctgcctctgactaagggataacccggcgaaagtcggactaataccttatgaggaaagtcggtcagtgatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatgggcgagagcctgaaccagccaagtagcgtgcaggatgacggcctatgggttgtaaactgcttttatgtggggatatgcaggtaccacatgaataaggaccggctaattccgtgccagcagccgcggtaatacggaaggtccaggcgttatccggatttattgggtttaaagggagcgtaggccgtggattaagcgtgttgtgaaatgtagacgctcaacgtctgaattgcagtgcgaactggttcacttgagtatgcacaacgtaggcggaattcgtcgtgtagcggtgaaatgcttagatatgacgaagaactccgattgcgaaggcagcttacgggagcaactgacgctgaagctcgaaggtgcgggtatcaaacaggattagataccctggtagtccgcacagtaaacgatggatgcccgttgttagttaattagcgaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgggcgcaacccctctcttcagttgccatcagctgggcactctggagacactgccaccgtaaggtggaggaaggtggggatgacgtcaaatcagcacggcccttacgtccggggctacacacgtgttacaatggccggcagagggacggtgtaatgcaaattgcatccaatcttgccggtcccagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgttcggcctagggcaaaactggtaattggggctaagtcgtaacaaggtagccgtaccggaaggtgcggctggatcacctcctt

SEQ ID NO: 1539 - DNA, 1341 bp, Prevotella sp.
  oral clone GI059
gagtttgatcctggctcaggatgaacgctagctacaggcttaacacatgcaagtcgagggaccggcgcacgggtgagtaacgcgtatccaaccttcccattactgtgggataacctgccggaaggcagactaatacctcatagttaaagtcggtaatggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatggacgtaagtctgaaccagccaagtagcgtgcaggatgacggcctatgggttgtaaactgcttttgtatggggatatgcaggtaccatacgaataaggaccggctaattccgtgccagcagccgcggtaatacggaaggttcgggcgttatccggatttattgggtttaaagggagcgtaggccggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgactgacgctgaagctcgaaggtgcgggtatcgaacaggattagataccctggtagtccgcacagtaaacgatggatgcccgctgttggtatatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctctcttcagttgccatcagctgggcactctggagacactgccaccgtaaggtggaggaaggtggggatgacgtcaaatcagcacggcccttacgtccggggctacacacgtgttacaatggccggcagagggacggtgtaatgcaaattgcatccaatcttgccggtcccagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgttcggcctagggcaaaactggtaattggggctaagtcgtaacaaggtagccgtaccggaaggtgcgg

SEQ ID NO: 1540 - DNA, 1357 bp, Prevotella sp.
  oral clone GU027
gagtttgattctggctcaggatgaacgctagctacaggcttaacacatgcaagtcgcgggaccggcgcacgggtgagtaacgcgtatccaacctgcccttcaccacgggataacccggcgaaagtcggactaataccgtatgttgaaaggcggtgaaggatggggatgcgtccgattagccagacggcggggtaacggcccaccgtggcgacgatcggtaggggttctgagaggaaggtcccccacactggaactgagacacggtccagactcctacgggaggcagcagtgaggaatattggtcaatgggcgtaagcctgaaccagccaagtagcgtgcaggatgacggcctatgggttgtaaactgcttttatgcggggatatgcaggtaccgcatgaataaggaccggctaattccgtgccagcagccgcggtaatacggaaggtccgggcgttatccggatttattgggtttaaagggagcgtaggccgcgccttaagcgtgttgtgaaatccgggtgctcaacatccggcttgcagcgcgaactggggcgcttgagtgcgcagaaagtaggcggaattcgtggtgtagcggtgaaatgcttagatatcacgaggaactccgattgcgaaggcagcctactgtagcgactgacgctgatgctcgaaagcgtgggtatcgaacaggattagataccctggtagtccacgcggtaaacgatggatgctcgttgtcggccggtcggtgaccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggaggtgctgcatggttgtcgtcagctcgtgccgtgaggtgtcggcttaagtgccataacgagcgcaacccccgtcttcagttgccatcggccgggcactctggagatactgccaccgcaaggtggaggaaggtggggatgacgtcaaatcagcacggcccttacgtccggggctacacacgtgttacaatggcgcacagagagtcggtggcatgcgagtgccatccaatcctctgcgtctcagttcggatggggtctgcaacccgaccccagaagctggattcgctagtaatcgcgcatcagccatggcgcggtgaatacgttcccgggccttgtacacaccgcccgtcaagccatgaaagccgggggcgcctgaagtccgtgtcggcctagggtgaaaccggtgattggggctaagtcgtaacaaggtagccgtaccggaaggtgcggctggatcacctcctt

SEQ ID NO: 1541 - DNA, 1357 bp, Prevotella sp.
  oral clone HF050
gagtttgattctggctcaggatgaacgctagctacaggcttaacacatgcaagtcgagggaccggcgcacgggtgcgtaacgcgtatcaaacctgcctcatactcggggatagccttgcgaaagtaagattaatacccgatgttcaaagtcggtatgagatggtgatgcgtccgattaggtagtaggcggggtaacggcccacctagccttcgatcggtaggggttctgagaggaaggtcccccacactggaactgagacacggtccagactcctacgggaggcagcagtgaggaatattggtcaatggacgcaagtctgaaccagccaagtagcgtgcaggatgacggcctctgggttgtaaactgcttttagttgggaatatgtatgtaccttcagaaaaaggaccggctaattccgtgccagcagccgcggtaatacggaaggtccaggcgttatccggatttattgggtttaaagggagcgtaggcggattattaagtcagtggtgaaagacggtggctcaaccatcgttaaccattgaaactggtagtcttgagtgcagacagggatgctggaactcgtggtgtagcggtgaaatgcttagatatcacgatgaactccgatcgcgaaggcaggtgtccgggctgactgacgctgaggctcgaaagtgtgggtatcacacaggattagataccctggtagtccacacagtaaacgatgtatactcgcggtttgcgagtaagccgccaagcgaaagcattaagtataccacctggggagtacgccggcaacggtgaaactcaaaggaattgacgggggcccgcacaagcggaggaacatgtggtttaattcgatgatacgcgaggaaccttacccgggcttgaactatggaggtgctgcatggttgtcgtcagctcgtgccgtgaggtgtcggcttaagtgccataacgagcgcaacccttttccttggttgccatcagctgggcactccagggaaactgccatcggtaagatggaggaaggtggggatgacgtcgaatcagcacggcccttacgtccggggctacacacgtgttacaatggggggcagaaggtcgctacctggtgacaggatgctaatctgccctctctcagttcggatggagtctgcaacccgactccagaagctggattcgctagtaatcgcgcatcagccatggcgcggtgaatacgttcccgggccttgtacacaccgcccgtcaagccatgaaagccgggggtgcctgaaagccgtgtcggcctagggtaaaactggtgattggggctaagtcataacaaggtacccgtaccggaaggtgcggctggaacacctcctt

SEQ ID NO: 1542 - DNA, 1518 bp, Prevotella sp.
  oral clone ID019
gagtttgatcctggctcaggatgaacgctagctacaggcttaacacatgcaagtcgaggggcagcatggaagaagcttgcttcttctgatggcgaccggcgcacgggtgcgtaacgcgtatcaaacctgcctcatactcggggatagccttgcgaaagtaagattaatacccgatgttattagttctccgcatggtggactaatcaaagatttatcggtatgagatggtgatgcgtccgattaggtagtaggcggggtaacggcccacctagccttcgatcggtaggggttctgagaggaaggtcccccacactggaactgagacacggtccagactcctacgggaggcagcagtgaggaatattggtcaatggacgaaagtctgaaccagccaagtagcgtgcaggatgacggccctccgggttgtaaactgctttcagtcgggaataaaaaaagggacgtgtcccttattgtatgtaccttcagaaaaaggaccggctaattccgtgccagcagccgcggtaatacggaaggtccaggcgttatccggatttattgggtttaaagggagcgtaggcggattgttaagtcagcggttaaagggtgtggctcaaccatacattgccgttgaaactggcgatcttgagtgcagacagggatgccggaattcgtggtgtagcggtgaaatgcttagatatcatgaagaactccgatcgcgaaggcaggtgtccgggctgcaactgacgctgaggctcgaaagtgtgggtatcaaacaggattagataccctggtagtccacacagtaaacgatgtatactcgcggtttgcgatagattgtaagccgccaagcgaaagcattaagtataccacctggggagtacgccggcaacggtgaaactcaaaggaattgacgggggcccgcacaagcggaggaacatgtggtttaattcgatgatacgcgaggaaccttacccgggcttgaactaacggtgacgaatctagagatagatttttcttcggacaccgttggaggtgctgcatggttgtcgtcagctcgtgccgtgaggtgtcggcttaagtgccataacgagcgcaacccttctcctcggttgccatcgggtaatgccgggcactccgtggacactgccatcgtaagatgtgaggaaggtggggatgacgtcaaatcagcacggcccttacgtccggggctacacacgtgttacaatggccggtacagagggatggtgtaatgcaaattgcatcatatcttgaaagccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccgcaaggatcggcctagggcaaaactggtgattggggctaagtcgtaacaaggtagccgtaccggaaggtgcggctggaacacctcctt

SEQ ID NO: 1543 - DNA, 1269 bp, Prevotella sp.
  oral clone IDR-CEC-0055
tcctggctcaggatgaacgctagctacaggcttaacacatgcaagtcgagggaccggcgcacgggtgagtaacgcgtatccaaccttcccataactaaggaataccccgtagaaatgcggcctaatcccttatggttaaagtcggttatggatggggatgcgtctgattagcttgctggcggggtaacggcccaccagggcatcgatcagtaggggttctgagaggaaggtcccccacattggaactgagacacggtccaaactcctacgggaggcagcagtgaggaatattggtcaatgggcggaagcctgaaccagccaagtagcgtgcaggatgacggcctatgggtcgtaaactgctttttaaggtgaatatgcatgtagccttggaataaggaccggctaattccgtgccagcagccgcggtaatacggaaggtccaggtgttatccggatttattgggtttaaagggagcgtaggccgcaggttaagtgtgttgtgaaaagcagtcgcccaacgtctgccttgcagcgcaaactgtcctgcttgagtgcgcacaacgcaggcggaattcgtcgtgtagcggtgaaatgcttagatatgacgaagaactccgattgcgaaggcagcttgcgggagcgactgacgctgaagctcgaaagtgcgggtatcgaacaggattagataccctggtagtccgcacggtaaacgctggatgcccgtttttggctagtcagagaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctttcttcagttgccatcggccgggcactctgtagatactgccgccgtaaggtggaggaaggtggggatgacgtcaaatcagcacggcccttacgtccggggctacacacgtgttacaatggggggcagcgagcgggatgcccgcaaggtcattcaaatcaatcccccctcagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgtac

SEQ ID NO: 1544 - DNA, 1355 bp, Prevotella sp.
  oral clone IK053
gagtttgattctggctcaggatgaacgctagctacaggcttaacacatgcaagtcgcgggaccggcgcacgggtgagtaacgcgtatccaacctacctattaccacgggataacccggcgaaagtcggactaataccgtatgtgtaaagcggtaatagatggggatgcgtccgattagttagttggcggggtaacggcccaccaagacgtcgatcggtaggggttctgagaggaaggtcccccacactggaactgagacacggtccagactcctacgggaggcagcagtgaggaatattggtcaatgggcgtaagcctgaaccagccaagtagcgtgcaggatgacggcctatgggttgtaaactgcttttatgcaagaatatgcaggtattgcatgaataaggaccggctaattccgtgccagcagccgcggtaatacggaaggtccgagcgttatccggatttattgggtttaaagggagcgtaggcggccttttaagcgtgttgtgaaattcagttgctcaacatctgacttgcagcgcgaactggggggcttgagtatgctgaaggtaggcggaattcgtggtgtagcggtgaaatgcttagatatcacgaagaactccgattgcgaaggcagcttactgcagctactgacgctgatgctcgaaagcgtgggtatcgaacaggattagataccctggtagtccacgcggtaaacgatggatgctcgttgttggtatatcagtgaccaagtgaaaacgttaagcatcccacctggggagtacgccggcaacggtgaaactcaaaggaattgacgggggcccgcacaagcggaggaacatgtggtttaattcgatgatacgcgaggaaccttacccgggcttgaactgcggaggtgctgcatggttgtcgtcagctcgtgccgtgaggtgtcggcttaagtgccataacgagcgcaacccctttttatagttgccatcggccgggcactctgtagatactgccgccgaaggtggaggaaggcggggatgacgtcaaatcatcacggcccttacgtccggggctacacacgtgttacaatggcgcgcagcgagttggtgttatgtgagtagcatctaatcctgcgcgcctcagttcggatggggtctgcaacccgaccccagaagctggattcgctagtaatcgcgcatcagccatggcgcggtgaatacgttcccgggccttgtacacaccgcccgtcaagccatgaaagccgggggcgcctgaagtccgtgtcggcctaaggtgaaaccggtgattggggctaagtcgtaacaaggtagccgtaccggaaggtgcggctggatcacctcctt

SEQ ID NO: 1545 - DNA, 1356 bp, Prevotella sp.
  oral clone IK062
gagtttgattctggctcaggatgaacgctagctacaggcttaacacatgcaagtcgagggaccggcgcacgggtgcgtaacgcgtatcaaacctgcctcatactcggggatagccttgcgaaagtaagattaatacccgatgttcaaagtcggtatgagatggtgatgcgtccgattaggtagtaggcggggtaacggcccacctagccttcgatcggtaggggttctgagaggaaggtcccccacactggaactgagacacggtccagactcctacgggaggcagcagtgaggaatattggtcaatggacgaaagtctgaaccagccaagtagcgtgcaggatgacggcctctgggttgtaaactgcttttagttgggaatatgtatgtaccttcagaaaaaggaccggctaattccgtgccagcagccgcggtaatacggaaggtccaggcgttatccggatttattgggtttaaagggagcgtaggcggattattaagtcagtggtgaaagacggtggctcaaccatcgttagccattgaaactggtagtcttgagtgcagacagggatgctggaactcgtggtgtagcggtgaaatgcttagatatcacgatgaactccgatcgcgaaggcaggtgtccgggctgactgacgctgaggctcgaaagtgtgggtatcaaacaggattagataccctggtagtccacacagtaaacgatgtatactcgcggtttgcgtgtaagccgccaagcgaaagcattaagtataccacctggggagtacgccggcaacggtgaaactcaaaggaattgacgggggcccgcacaagcggaggaacatgtggtttaattcgatgatacgcgaggaaccttacccgggcttgaactatggaggtgctgcatggttgtcgtcagctcgtgccgtgaggtgtcggcttaagtgccataacgagcgcaacccttttccttggttgccatcagctgggcactccagggatactgccatcgtaagatggaggaaggtggggatgacgtcaaatcagcacggcccttacgtccggggctacacacgtgttacaatggggggcagaaggtcgctacctggtgacaggatgctaatctcacctctctcagttcggatggagtctgcaacccgactccagaagctggattcgctagtaatcgcgcatcagccatggcgcggtgaatacgttcccgggccttgtacacaccgcccgtcaagccatgaaagccgggggtgcctgaaagccgtgtcggcctagggtaaaactggtgattggggctaagtcgtaacaaggtagccgtaccggaaggtgcggctggatcacctcctt

SEQ ID NO: 1546 - DNA, 1285 bp, Prevotella sp.
  oral clone P4PB_83 P2
gatgaacgctagctacaggcttaacacatgcaagtcgagggaccggcgcacgggtgagtatcgcgtatccaaccttcccattactgtgggataacctgccgaaaggcagactaataccgcatggttaaagtcggtaatggatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatggacgtaagtctgaaccagccaagtagcgtgcaggatgacggcctatgggttgtaaactgcttttacaggggaatatgcatgtaccctgcgaataaggaccggctaattccgtgccagcagccgcggtaatacggaaggtcctggtgttatccggatttattgggtttaaagggagcgtaggccgtagattaagtgtgttgtgaaatgtagtcgcccaacgtctgccttgcagcgcaaactggtttacttgagtacgcacaacgcaggcggaattcgtcgtgtagcggtgaaatgcttagatatgatgaagaactcctattgcgaaggcagcttgcgggagcgactgacgctgaggctcgaaagtgcgggtatcgaacaggattagataccctggtagtccgcacggtaaacgatggatgcccgtttttggctagccagagaccaagcgaaagcattaagcatcccacctggggagtacgccggcaacggtgaaactcaaaggaattgacgggggcccgcacaagcggaggacatgtggttaattcgatgatacgcgaggaaccttacccgggcttgaattgtgaaggtgctgcatggttgtcgtcagctcgtgccgtgaggtgtcggcttaagtgccataacgagcgcaacccctctcttcagttgccatcagctgggcactctggagacactgccaccgtaaggtggaggaaggtggggatgacgtcaaatcagcacggcccttacgtccggggctacacacgtgttacaatggccggcagagggatggtgtaatgcaaattgcatcaaatcttgccggtcccggttcggatggggtctgcaacccgaccccagaagctggattcgctagtaatcgcgcatcagccatggcgcggtgaatacgttcccgggccttgtacacaccgcccgtcaagccatgaaagccgggggtgcctgaagttcgtagcgacctagggcaaaactggtgatgggggc

SEQ ID NO: 1547 - DNA, 1508 bp, Prevotella sp.
  oral taxon 292
agagtttgatcctggctcaggatgaacgctagctacaggcttaacacatgcaagtcgaggggaaacgggggaatagcttgctattctttgtcgtcgaccggcgcacgggtgagtaacgcgtatccaaccttcccataactaaggaataccccgtagaaatgcggcctaatcccttatggtctcttatgcctgtcatgggaataagagtaaagatttatcggttatggatggggatgcgtctgattagcttgctggcggggtaacggcccaccagggcatcgatcagtaggggttctgagaggaaggtcccccacattggaactgagacacggtccaaactcctacgggaggcagcagtgaggaatattggtcaatgggcgtaagcctgaaccagccaagtagcgtgcaggatgacggccctatgggttgtaaactgctttttaaggtgaataaagaggggcacgcgtgccctgttgcatgtagccttggaataaggaccggctaattccgtgccagcagccgcggtaatacggaaggtccgggtgttatccggatttattgggtttaaagggagcgtagsccgcaggttaagtgtgttgtgaaaagcagtcgcccaacgtctgccttgcagcgcaaactgtcctgcttgagtgcgcacaacgcaggcggaattcgtcgtgtagcggtgaaatgcttagatatgacgaagaactccgattgcgaaggcagcttgcgggagcgcaactgacgctgaagctcgaaagtgcgggtatcgaacaggattagataccctggtagtccgcacggtaaacgctggatgcccgtttttggcttattttaagtcagagaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgccagagacggctccagagatggagcttcccttcggggctctggtgaaggtgctgcatggttgtcgtcagctcgtgccgtgaggtgtcggcttaagtgccataacgagcgcaacccctttcttcagttgccatcgggtaatgccgggcactctgtagatactgccgccgtaaggtgtgaggaaggtggggatgacgtcaaatcagcacggcccttacgtccggggctacacacgtgttacaatggtcggagcagcaggaagctacctggcgacaggatgctgatcccgaaacccggcctcagttcggactggagtctgcaacccgactccacgaagccggattcgctagtaatcgcgcatcagccatggcgcggtgaatacgttcccgggccttgtacacaccgcccgtcaagccatgaaagccgggggtgcctgaaagccgtgaccgcgagggtcggcctagggtaaaaccggtgattggggctaagtcgtaacaaggtagccgtaccggaaggtgc

SEQ ID NO: 1548 - DNA, 1533 bp, Prevotella sp.
  oral taxon 299
ttacaatgtagagtttgatcctggctcaggatgaacgctagctacaggcttaacacatgcaagtcgaggggcagcatgttggttgcttgcaaccaatgatggcgaccggcgcacgggtgagtaacgcgtatccaacctacccaatactcaggcataacccgttgaaagacggactaattcctgatggtatgtatttttctcatgatttatacattaaagaacttcggtattggatggggatgcgtctgattagtttgttggtgaggtaacggctcaccaaggcatcgatcagtaggggttctgagaggaaggtcccccacattggaactgagacacggtccaaactcctacgggaggcagcagtgaggaatattggtcaatggatgaaaatctgaaccagccaagtagcgtgcaggatgacggccctatgggttgtaaactgcttttatgtgagaataaagttaggtatgtatacttatttgcatgtatcacatgaataaggaccggctaattccgtgccagcagccgcggtaatacggaaggtccaggcgttatccggatttattgggtttaaagggtgcgtaggccgtttgataagcgtgctgtgaaatatagtggctcaacctctatcgtgcagcgcgaactgtcgaacttgagtgcgtagtaggtaggcggaattcgtggtgtagcggtgaaatgcttagatatcacgaagaactccgattgcgaaggcagcttaccgtaacgttactgacgcttaagcacgaaggtgcgggtatcgaacaggattagataccctggtagtccgcacagtaaacgatggatgctcgctgttggccttttatggtcagtggcttagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcagctgaacgattcagagatgatgaggcccttcggggcagctgtggaggtgctgcatggttgtcgtcagctcgtgccgtgaggtgtcggcttaagtgccataacgagcgcaaccccttttcttagttgccatcaggtaatgctgggcactctgggaatactgccaccgtaaggtgtgaggaaggtggggatgacgtcaaatcagcacggcccttacgtccggggctacacacgtgttacaatggcgcatacagaatgttggtttcatgcaaatgagatctaatcttcaaagtgcgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctaaagtccgtgaccgcaagggtcggcctagggtgaaactggtgattggggctaagtcgtaacaaggtagccgtaccggaaggtgcggctggaacacctcctttct

SEQ ID NO: 1549 - DNA, 1209 bp, Prevotella sp.
  oral taxon 300
gatgaacgctagctacaggcttaacacatgcaagtcgaggggaaacgggagaatagcttgctattctttgtcgtcgaccggcgcacgggtgagtaacgcgtatccaaccttcccatagctaaggaataccccgtagaaatgcggcctaatcccttatggtctcttatacctgacatcggaataagagtaaagatttatcggttatggatggggatgcgtctgattagcttgctggcggggtaacggcccaccagggcatcgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggtgtgtaaactgctttttaaggtgaataaagaagggcacgtgtgccctgttgcatgtagccttggaataaggaccggctaattccgtgccagcagccgcggtaatacggaaggtccaggtgttatccggatttattgggtttaaagggagcgtaggccgcaggttaagtgtgttgtgaaaagcagtcgcccaacgtctgccttgcagcgcaaactgtcctgcttgagtgcgcacaacgcaggcggaattcgtcgtgtagcggtgaaatgcttagatatgacgaagaactccgattgcgaaggcagcttgcgggagcgcaactgacgctgaagctcgaaagtgcgggtatcgaacaggattagataccctggtagtccgcacggtaaacgctggatgcccgtttttggcttattttaagtcagagaccaagcgaaagcattaagcatcccacctggggagtacgccggcaacggtgaaactcaaaggaattgacgggggcccgcacaagcggaggaacatgtggtttaattcgatgatacgcgaggaaccttacccggggcttgaattgccagagacggctccagagatggagcttcccttcgggggctctggtgacggtgctgcatgggttgtcgtcagctcgtgccgtgaggtgtcagcttaagtgccataacgagcgcaccccctttcttcagttgccatcggggtattgccctggcactctgtaaaatccgccgccgatcgggttgaggaagggtgggactacgtcaaatagcaggccctacgtcgggctaacaggttaaa

SEQ ID NO: 1550 - DNA, 1521 bp, Prevotella sp.
  oral taxon 302
agagtttgatcctggctcaggatgaacgctagctacaggcttaacacatgcaagtcgaggggaaacgacattgaaagcttgcttttaatgggcgtcgaccggcgcacgggtgcgtaacgcgtatcgaacctgccctttactcagggatagccttgcgaaagtaagattaatacctgatagtgttgtgatgaggcatcttgttgcaactaaagatttattggtaaaggatggcgatgcgtctgattaggtagtaggcggggtaacggcccacctagccgacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctctgggttgtaaactgcttttagttgggaacaaaaaaggcgacgtgtcgcctctggagtgtaccatcagaaaaaggaccggctaattccgtgccagcagccgcggtaatacggaaggtccaggcgttatccggatttattgggtttaaagggagcgtaggcggacgattaagtcagctgtgaaagtttgcggctcaaccgtaaaattgcagttgaaactggttgtcttgagtgcacgcagggatgttggaattcatggtgtagcggtgaaatgcttagatatcatgaagaactccgatcgcgaaggcatatgtccggagtgcaactgacgctgaggctcgaaagtgcgggtatcgaacaggattagataccctggtagtccgcacagtaaacgatgaatactcgcagtatgcgatatagtgtatgctgccaagtgaaaacgttaagtattccacctggggagtacgccggcaacggtgaaactcaaaggaattgacgggggcccgcacaagcggaggaacatgtggtttaattcgatgatacgcgaggaaccttacccgggcttgaactaagcaggaagatgggcagagaggcctgttgtcttcggacctgcttggaggtgctgcatggttgtcgtcagctcgtgccgtgaggtgtcggcttaagtgccataacgagcgcaacccttctccacgtttgccatcaggtagagctgggcactccgtggatactgccatcgtaagatgtgaggaaggtggggatgacgtcaaatcagcacggcccttacgtccggggctacacacgtgttacaatggccggtacagagggaagccaccaggcgactgggcgctgatccattaaaaccggtctcagttcggactggagtctgcaacccgactccacgaagctggattcgctagtaatcgcgcatcagccatggcgcggtgaatacgttcccgggccttgtacacaccgcccgtcaagccatgaaagccgggggtgcctgaaagctgtgaccgtaaggggcggcctagggtaaaaccggtgattggggctaagtcgtaacaaggtagccgtaccggaaggtgcggctggaacacct

SEQ ID NO: 1551 - DNA, 1505 bp, Prevotella sp.
  oral taxon 310
gagtttgatcctggctcaggatgaacgctagctacaggcttaacacatgcaagtcgaggggaaacggcatttagtgcttgcaccgaatggacgtcgaccggcacacgggtgagtaacgcgtatccaaccttcccacaactaagggataacctgccgaaaggcagactaataccttatgtaatcctttgatggcatcagataaggataaaagatttatcggtaaaggatggggatgcgtctgattagcttgttggtgaggtaaaggctcaccaaggcgacgatcagtaggggttctgagaggaaggtcccccacattggaactgagacacggtccaaactcttacgggaggcagcagtgaggaatattggtcaatgggcggaagcctgaaccagccaagtagcgtgcaggaagacggccctatgggttgtaaactgcttttatacgagaataatttgatgcacgtgtgcgttattgcatgtatcgtatgaataaggaccggctaattccgtgccagcagccgcggtaatacggaaggtccaggcgttatccggatttattgggtttaaagggagtgtaggcggtttgttaagcgtgttgtgaaatttaggtgctcaacatttaacttgcagcgcgaactgtcagtcttgagtacacgcaacgtatgcggaattcatggtgtagcggtgaaatgcttagatatcatgaagaactccgattgcgaaggcagcatacgggagtgtaactgacgcttaagctcgaaggtgcgggtatcgaacaggattagataccctggtagtccgcacagtaaacgatggatgcccgctgttagcgcctggcgttagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagaggaattatttagagataaatacgcccttcggggtctctgtgaaggtgctgcatggttgtcgtcagctcgtgccgtgaggtgtcggcttaagtgccataacgagcgcaaccccttttcttagttgccatcaggtaatgctgggcactctgggaacactgccaccgcaaggtgtgaggaaggtggggatgacgtcaaatcagcacggcccttacgtccggggctacacacgtgttacaatggccggtacagagggatggtgtaatgcaaattgcatcaaatcttaaaagccggtcccagttcggactgaggtctgcaacccgacctcacgaagctggattcgctagtaatcgcgcatcagccatggcgcggtgaatacgttcccgggccttgtacacaccgcccgtcaagccatgaaagccgggggtgcctgaagttcgtaaccgtaaggagcgacctagggcaaaactggtaattggggctaagtcgtaacaaggtagccgtaccggaaggtgc

SEQ ID NO: 1552 - DNA, 1534 bp, Prevotella sp.
  oral taxon 317
ttacaatggagagtttgatcctggctcaggatgaacgctagctacaggcttaacacatgcaagtcgcggggcagcatgggggttgcttgcaatccctgatggcgaccggcgcacgggtgagtaacgcgtatccaacctgcccttcaccacgggataacccggcgaaagtcggactaataccgtatgttgtccattgacggcatccgatttggacgaaaggcttagcggtgagggatggggatgcgtccgattagctcgacggcggggtaacggcccaccgtggcgacgatcggtaggggttctgagaggaaggtcccccacactggaactgagacacggtccagactcctacgggaggcagcagtgaggaatattggtcaatgggcgtaagcctgaaccagccaagtagcgtgcaggatgacggccctatgggttgtaaactgcttttatgcggggataaaggagcccacgtgtgggctttttgcaggtaccgcatgaataaggaccggctaattccgtgccagcagccgcggtaatacggaaggtccgggcgttatccggatttattgggtttaaagggagcgtaggccgccccttaagcgtgttgtgaaatgcgggtgctcaacatccgacttgcagcgcgaactggggggcttgagtgcgccgaaagtaggcggaattcgtggtgtagcggtgaaatgcttagatatcacgaagaactccgattgcgaaggcagcttactgtagcgcaactgacgctgatgctcgaaagcgtgggtatcgaacaggattagataccctggtagtccacgcggtaaacgatggatgctcgttgtcggcctttgaggccggtgaccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggcggaacgattccgagaggatgaggcccttcggggctgccgcggaggtgctgcatggttgtcgtcagctcgtgccgtgaggtgtcggcttaagtgccataacgagcgcaacccccgtcttcagttgccatcgggttatgccgggcactctggagatactgccaccgcaaggtgtgaggaaggtggggatgacgtcaaatcagcacggcccttacgtccggggctacacacgtgttacaatggcgcatacagagagtaggtggcatgcgaatgccatccaatccttaaagtgcgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctgaagtccgtgaccgcgagggtcggcctagggtgaaaccggtgattggggctaagtcgtaacaaggtagccgtaccggaaggtgcggctggaacacctcctttct

SEQ ID NO: 1553 - DNA, 1434 bp, Prevotella sp.
  oral taxon 472
tggcgaccggcgcacgggtgagtaacgcgtatccaacctgcccttcaccacgggataacccggcgaaagtcggactaataccgtatgttgtccattgacggcatccgatttggacgaaaggctttgcggtgaaggatggggatgcgtccgattagctggacggcggggtaacggcccaccgtggctacgatcggtaggggttctgagaggaaggtcccccacactggaactgagacacggtccagactcctacgggaggcagcagtgaggaatattggtcaatgggcgtaagcctgaaccagccaagtagcgtgcaggatgacggccctatgggttgtaaactgcttttatgcggggataaagtggcccacgtgtgggtttttgcaggtaccgcatgaataaggaccggctaattccgtgccagcagccgcggtaatacggaaggtccgggcgttatccggatttattgggtttaaagggagcgtaggccgcgccttaagcgtgttgtgaaatccgggtgctcaacatccggcttgcagcgcgaactggggcgcttgagtgcgctgaaagtaggcggaattcgtggtgtagcggtgaaatgcttagatatcacgaggaactccgattgcgaaggcagcctactgtagcgctactgacgctgatgctcgaaagcgtgggtatcgaacaggattagataccctggtagtccacgcggtaaacgatggatgctcgttgtcggcccttcgggtcggtgaccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggcggaacgattcggagacgatgaggcccttcggggccgccgcggaggtgctgcatggttgtcgtcagctcgtgccgtgaggtgtcggcttaagtgccataacgagcgcaacccccgtcttcagttgccatcgggtgatgccgggcactctggagatactgccaccgcaaggtgcgaggaaggtggggatgacgtcaaatcagcacggcccttacgtccggggctacacacgtgttacaatggcgcatacagagagtcggtggcatgcgaatgccatccaatcctcaaagtgcgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctgaagtccgtgaccgcgagggtcggcctagggtgaaaccggtgattggggctaagtcgtaacaaggtagccgtaccggaaggtgcggctggaacacctcctttct

SEQ ID NO: 1554 - DNA, 1504 bp, Prevotella sp.
  oral taxon 781
gagtttgatcctggctcaggatgaacgctagctacaggcttaacacatgcaagtcgcggggcagcatgttggttgcttgcaaccgatgatggcgaccggcgcacgggtgagtaacgcgtatccaacctacctattaccacgggataacccggcgaaagtcggactaataccgtatgtagtcctccaatggcatcagcagtggactaaaggtttggcggtaatagatggggatgcgtccgattagctagttggtgaggtaatggctccccaaggcttcgatcggtaggggttctgagaggaaggtcccccacactggaactgagacacggtccagactcctacgggaggcagcagtgaggaatattggtcaatggacgagagtctgaaccagccaagtagcgtgcaggatgactgccctatgggttgtaaactgcttttatgcggggataaagtgaggaacgtgttctctattgcaggtaccgcatgaataaggaccggctaattccgtgccagcagccgcggtaatacggaaggttcaggcgttatccggatttattgggtttaaagggagcgtaggccgttttttaagcgtgttgtgaaatgtaccggctcaaccggtgatgtgcagcgcgaactggaagacttgagtgcgtagtaagcaggcggaattcgtggtgtagcggtgaaatgcttagatatcacgaagaactccgatagcgcaggcagcttgctgcatcgcaactgacgctgatgctcgaaagcgtgggtatcaaacaggattagataccctggtagtccacgcggtaaacgatggatgctcgttgtcaggcctttgggtttggtgaccaagtgaaaacgttaagcatcccacctggggagtacgccggcaacggtgaaactcaaaggaattgacgggggcccgcacaagcggaggaacatgtggtttaattcgatgatacgcgaggaaccttacccgggcttgaactgcggcggaacgattcagagatgatgaggtccttcgggactgccgcggaggtgctgcatggttgtcgtcagctcgtgccgtgaggtgtcggcttaagtgccataacgagcgcaaccccttttcttagttgccatcgggtaatgccgggcactctgggaatactgccaccgtaaggtgtgaggaaggtggggatgacgtcaaatcagcacggcccttacgtccggggctacacacgtgttacaatggcgcatacagatagttggttgtgtgcaaacatgatctaatctttaaagtgcgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctgaagtccgtgaccgcgagggtcggcctagggtgaaaccggtgattggggctaagtcgtaacaaggtagccgtaccggaaggtgc

SEQ ID NO: 1555 - DNA, 1505 bp, Prevotella sp.
  oral taxon 782
gagtttgatcctggctcaggatgaacgctagctacaggcttaacacatgcaagtcgaggggaaacggcgttgagtgcttgcactcttcggacgtcgaccggcgcacgggtgagtaacgcgtatccaaccttcccatgactgggggataacctgccgaaaggcagactaataccccatggtcttcactgacggcatcatatgtgaagtaaagattcatcggtcatggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatgggcgcaagcctgaaccagccaagtagcgtgcaggacgacggccctatgggttgtaaactgcttttgtacggggataaaacggcggacgcgtccgtccttgcaggtaccgtacgaataaggaccggctaattccgtgccagcagccgcggtaatacggaaggtccgggcgttatccggatttattgggtttaaagggagcgtaggccggggattaagtgtgttgtgaaatgtagacgctcaacgtctgacttgcagcgcatactggttcccttgagtacgcacaacgtcggcggaattcgtcgtgtagcggtgaaatgcttagatatgacgaagaactccgattgcgaaggcagctgacgggagcgcaactgacgcttaagctcgaaggtgcgggtatcgaacaggattagataccctggtagtccgcacggtaaacgatggatgcccgctgttggtacctggtatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcaggagaacgatacagagatgttgaggtccttcgggactcctgtgaaggtgctgcatggttgtcgtcagctcgtgccgtgaggtgtcggcttaagtgccataacgagcgcaacccctctcttcagttgccatcaggttatgctgggcactctggagacactgccaccgtaaggtgtgaggaaggtggggatgacgtcaaatcagcacggcccttacgtccggggctacacacgtgttacaatggccggtacagagggacggtgcaacgcaagttgcatccaatcttgaaagccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccggaaggatcggcctagggcaaaactggtgattggggctaagtcgtaacaaggtagccgtaccggaaggtgc

SEQ ID NO: 1556 - DNA, 1386 bp, Prevotella sp.
  oral taxon F68
agagtttgatcctggctcaggatgaacgctggctacaggcttaacacatgcaagtcgtggggaaacgattggaggcgcttgcgcctctgaggcgtcgaccggcgcacgggtgagtaacgcgtatccaacctgccccgcggcaagggataatccgcagaaatgcggtctaataccttatgtgctccgaagaggacatctgattcggagcaaaggcttgccgccgcgggatggggatgcgtctgattagatagtaggcggggtaacggcccacctagtcgtcgatgggtaggggttctgagaggaaggtcccccacattggaactgagacacggtccaaactcctacgggaggcagcagtgaggaatattggtcaatgggcgagagcctgaaccagccaagtagcgtgcaggaagacggccctatgggttgtaaactgcttttatacgggaataaagtttgccacgtgtggcattttgcatgtaccgtaagaaaaaggatcggctaattccgtgccagcagccgcggtaatacggaagatccgagcgttatccggatttattgggtttaaagggagcgtaggcgggaatccaagtcagttgtgaaaccctgcggctcaaccgtagtcgtgcagttgaaactggatttcttgagtgcgcacagggcagacggaatttgtggtgtagcggtgaaatgcttagatatcacgaagaactccgatcgcgaaggcagtctgccggggcgctactgacgctgaggctcgaaagtgcgggtatcaaacaggattagataccctggtagtccgcactgtaaacgatggatacccgtggtcggttttttttattcggtcaccaagcgaaagcgttaagtatcccacctggggagtacgccggcaacggtgaaactcaaaggaattgacgggggcccgcacaagcggaggaacatgtggtttaattcgatgatacgcgaggaaccttacccgggcttgaattgcagaggaagtcaccggagacggtgatgtctttatagtctctgtgaaggtgctgcatggttgtcgtcagctcgtgccgtgaggtgtcggcttaagtgccataacgagcgcaacccctttttccggttgccatcaggtgatgctgggcactccggagacactgccatcgtaagatgtgaggaaggtggggatgacgtcaaatcagcacggcccttacgtccggggctacacacgtgttacaatggccggtacagaaggcagctcccacgcgagtggttgcgaatcccgaaagccggtcccagttcggactggagtctgcaacccgactccacgaagctggattcgctagtaatcgcgcatcagccacggcgcggtgaatacgttcccgggccttgtac

SEQ ID NO: 1557 - DNA, 1216 bp, Prevotella sp.
  oral taxon G60
gatgaacgctagctacaggcttaacacatgcaagtcgaggggaaacgatgagagagcttgctctctcaggcgtcgaccggcgcacgggtgagtaacgcgtatccaacctgcccattacaggggaataaccttgcgaaagtaagactaatgccccatggtattctcagcagacatctaatgaggattaaagatttatcggtaatggatggggatgcgtctgattagcttgttggcggggtaacggcccaccaaggcaacgatcagtaggggttctgagaggaaggtcccccacattggaactgagacacggtccaaactcctacgggaggcagcagtggggaatattggtcaatggacgagagtctgaaccagccaagtagcgtgcaggatgacggccctatgggttgtaaactgcttttataggggaataaagtgatctacgtgtagtttattgtatgtaccctatgaataaggaccggctaattccgtgccagcagccgcggtaatacggaaggttcgggcgttatccggatttattgggtttaaagggagcgtaggccgtagattaagcgtgttgtgaaatgtagatgctcaacatctgacttgcagcgcgaactggtttactagagtgtgcacaacgtaggcggaattcgtcgtgtagcggtgaaatgcttagatatgacgaagaactccgattgcgaaggcagcttacgggagcacaactgacgctgaagctcgaaggtgcgggtatcaaacaggattagataccctggtagtccgcacagtaaacgctggatgcccgctgttggttcattagagtcagcggccaagcgaaagcattaagcatcccacctggggagtacgccggcaacggtgaaactcaaaggaattgacgggggcccgcacaagcggaggaacatgtggtttaattcgatgatacgcgaggaaccctaccccgggcctgaaattgcagacgaacgcggcagagatgccaagggcccttcggggcgtctgtgaaggtgctgcattggtgtcgtcagctcgtgccgtgaggtgtcggcctaagtgccataacgagcgcaaccccttttcttagttgccatcagggtcatgcctgggcactcatggaaaatccgcccacgataggggtgtaggaacgggtgggaaatacgttcaaatcaccacggcccttacgttcgggggcctacacctgtta

SEQ ID NO: 1558 - DNA, 1211 bp, Prevotella sp.
  oral taxon G70
gatgaacgctggctacaggcttaacacatgcaagtcgaggggaaacggcattgagtgcttgcactgaatggacgtcgaccggcgcacgggtgagtaacgcgtatccaaccttcccgttactgcgggataacctgccgaaaggcagactaataccgcatgttcttcgatgacggcatcagattcgaagcaaagatccgtcggtaacggagggggatgcgtctgattagctggttggcggggcgacggcccaccaaggcgacgatcagtaggggttctgagaggaaggtcccccacattggaactgagacacggtccaactcctacgggaggcagcagtgaggaatattggtcaatgggcggaagcctgaaccagccaagtagcgtgcaggaggacggccctacgggtgtgtaaactgcttttatgcggggataaagtgagggacgcgtccctttttgcaggtaccgcatgaataaggaccggctaattccgtgccagcagccgcggtaatacggaaggtccgggcgttatccggatttattgggtttaaagggagcgtaggccgtggattaagcgtgttgtgaaatgcaggtgctcaacgtctgcactgcagcgcgaactggtccacttgagtgtgcgcaacgcaggcggaattcgtcgtgtagcggtgaaatgcttagatatgacgaagaactccgattgcgaaggcagcttgcgggagcacaactgacgctgaagctcgaaagtgcgggtatcgaacaggattagataccctggtagtccgcacggtaaacgatggatgcccgttgtcaggctgtttcagcctggtgaccaagcgagagcattaagcatcccacctggggagtacgccggcaacggtgaaactcaaaggaattgacgggggcccgcacaagcggaggatcatgtggtttaattcgatgatacgcgaggaacctgacccggggcttgaattgcagacgaacgattcagagatgatgaggcccttcggggcgtctgtgacaggtgctgcatgggttgtcgtcagctcgtgccgtgaggtgtcagcctaaagtgccatagcgagcgccagcccctttcttcagtttgcacagggtgatgcctgggcactctgaaaaccctgccaccgcaagggtgtgaggaagggtggcaatacgtcaaacaccacgaccctacgttcggggcaacacagttt

SEQ ID NO: 1559 - DNA, 1218 bp, Prevotella sp.
  oral taxon G71
gatgaacgctagctacaggcttaacacatgcaagtcgaggggaaacggcgaagggtgcttgcactctccggacgtcgaccggcgcacgggtgagtaacgcgtatccaaccttcccatgaccgggggataacctgccgaaaggcagactaataccccatggccttcactgacggcatcatatgtgaagtaaagattcatcggtcatggatggggatgcgtctgattagcttgttggcggggaaacggcccaccaaggcgacgatcagtaggggttctgagaggaaggtcccccacattggaactgagacacggtccaaactcctacgggaggcagcagtgaggaatattggtcaatgggcgcaagcctgaaccagccaagtagcgtgcaggatgacggccctatgggttgtaaactgcttttgtacggggataaaacggcggacgtgtccgtccttgcaggtaccgtacgaataaggaccggctaattccgtgccagcagccgcggtaatacggaaggtccgggcgttatccggatttattgggtttaaagggagcgtaggccggggattaagtgtgttgtgaaatgtagacgctcaacgtctgacttgcagcgcatactggttcccttgagtacgcacaacgttggcggaattcgtcgtgtagcggtgaaatgcttagatatgacgaagaactccgattgcgaaggcagctgacgggagcgcaactgacgcttaagctcgaaggtgcgggtatcgaacaggattagataccctggtagtccgcacggtaaacgatggatgcccgctgttggtacctggtatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccggggcttgaattgcaagagaacgatacaagagatgttgagggtccttcgggactcctgtgaaggtgctgcatggttgtcgtcagctcgtgccgtgaggtgtcggcctaagtgccataccgaggcgcaccccctctcttcagttgcccatcaaggtattgcctggcacctcttggaaacccggtgccacccttaggggtttaggaaagggtggggagttacgttaaattccccacgggcctttactttcgggggcctcacct

SEQ ID NO: 1560 - DNA, 1433 bp, Prevotella sp.
  sp24
atgcaagtcgaggggcagcatgatcgaagcttgctttgattgatggcgaccggcgcacgggtgagtaacgcgtatccaaccttccctttagtagaggatagcccggcgaaagtcggattaatactctatattgtatttagaagacatctgaagaataccaaaggtttaccgctaaaggatggggatgcgtctgattaggttgttggcggggtaacggcccaccaagcctacgatcagtaggggttctgagaggaaggtcccccacattggaactgagacacggtccaaactcctacgggaggcagcagtgaggaatattggtcaatggacgaaagtctgaaccagccaagtagcgtgcaggatgacggccctatgggttgtaaactgcttttatatagggataaagtcggggacgtgtccccgtttgtaggtactatatgaataaggaccggctaattccgtgccagcagccgcggtaatacggaaggtccaggcgttatccggatttattgggtttaaagggagcgcaggctgatgattaagcgtgacgtgaaatgtagccgctcaacggctgtactgcgtcgcgaactggttatcttgagtgagttcgatgttggcggaattcgtggtgtagcggtgaaatgcttagatatcacgaagaactccgattgcgaaggcagccaacaaggcctttactgacgctaaagctcgaaggtgcgggtatcgaacaggattagataccctggtagtccgcacggtaaacgatggatgcccgctgtttgcgatatactgtgagcggccaagagaaatcgttaagcatcccacctggggagtacgccggcaacggtgaaactcaaaggaattgacgggggcccgcacaagcggaggaacatgtggtttaattcgatgatacgcgaggaaccttacccgggcttgaactgcagcggaaggatacagagatgttgacgccttcggggccgctgtggaggtgctgcatggttgccgtcagctcgtgccgtgaggtgtcggcttaagtgccataacgagcgcaacccttttctttagttgccatcaggtaatgctgggcactctggagatactgccaccgtaaggtgtgaggaaggtggggatgacgtcaaatcagcacggcccttacgtccggggctacacacgtgttacaatgggaggtacagagagctggatgtacgcaagtacgttctaatcctaaaagccttcctcagttcggattggggtctgcaacccgaccccatgaagctggattcgctagtaatcgcgcatcagccatggcgcggtgaatacgttcccgggccttgtacacaccgcccgtcaagccatgaaagccgggggcgcttgaagtccgtgaccgcaaggatcggcctagagcgaaactggtaattggggctaagtcgtaa

SEQ ID NO: 1561 - DNA, 1433 bp, Prevotella sp.
  sp34
atgcaagtcgaggggcagcatgatcgaagcttgctttgattgatggcgaccggcgcacgggtgagtaacgcgtatccaaccttccctttagtagaggatagcccggcgaaagtcggattaatactctatgttgtatttagaagacatctgaagaataccaaaggtttaccgctataggatggggatgcgtctgattaggttgttggcggggtaacggcccaccaagcctacgatcagtaggggttctgagaggaaggtcccccacattggaactgagactcggtccaaactcctacgggaggcagcagtgaggaatattggtcaatggacgaaagtctgaaccagccaagtagcgtgcaggatgacggccctatgggttgtaaactgcttttatatagggataaagtcggggacgtgtccccgtttgtaggtactatatgaataaggaccggctaattccgtgccagcagccgcggtaatacggaaggtccaggcgttatccggatttattgggtttaaagggagcgcaggctgatgattaagcgtgacgtgaaatgtagccgctcaacggctgaactgcgtcgcgaactggttatcttgagtgagttcgatgttggcggaattcgtggtgtagcggtgaaatgcttagatatcacgaagaactccgattgcgaaggcagccaacaaggcctttactgacgctaaagctcgaaggtgcgggtatcgaacaggattagataccctggtagtccgcacggtaaacgatggatgcccgctgtttgcgatatactgtgagcggccaagagaaatcgttaagcatcccacctggggagtacgccggcaacggtgaaactcaaaggaattgacgggggcccgcacaagcggaggaacatgtggtttaattcgatgatacgcgaggaaccttacccgggcttgaactgcagcggaaggatacagagatgttgacgccttcggggccgctgtggaggtgctgcatggttgtcgtcagctcgtgccgtgaggtgtcggcttaagtgccataacgagcgcaacccttttctttagttgccatcaggtaatgctgggcactctggagatactgccaccgtaaggtgtgaggaaggtggggatgacgtcaaatcagcacggcccttacgtccggggctacacacgtgttacaatgggaggtacagagagctggatgtacgcaagtacgttctaatcctaaaagccttcctcagttcggattggggtctgcaacccgaccccatgaagctggattcgctagtaatcgcgcatcagccatggcgcggtgaatacgttcccgggccttgtacacaccgcccgtcaagccatgaaagccgggggcgcttgaagtccgtgaccgcaaggatcggcctagagcgaaactggtaattggggctaagtcgtaa

SEQ ID NO: 1562 - DNA, 1488 bp, Prevotella stercorea
agagtttgatcctggctcaggatgaacgctagctacaggcttaacacatgcaagtcgaggggcagcatgtcggttgcttgcaaccgatgatggcgaccggcgcacgggtgagtaacgcgtatccaacctacccttgtccatcggataacccgtcgaaaggcggcctaacacgatatgcggttcacagcaggcatctaacgtgaacgaaatgtgaaggagaaggatggggatgcgtctgattagcttgttggcggggtaacggcccaccaaggctacgatcagtaggggttctgagaggaaggtcccccacattggaactgagacacggtccaaactcctacgggaggcagcagtgaggaatattggtcaatggacgagagtctgaaccagccaagtagcgtgcaggatgacggccctatgggttgtaaactgcttttatagggggataaagtgtgccacgtgtggcatattgcaggtaccctatgaataaggaccggctaattccgtgccagcagccgcggtaatacggaaggtccgggcgttatccggatttattgggtttaaagggagcgtaggccgtttggtaagcgtgttgtgaaatgtcggggctcaacctgggcattgcagcgcgaactgccagacttgagtgcgcaggaagtaggcggaattcgtcgtgtagcggtgaaatgcttagatatgacgaagaactccgattgcgaaggcagcctgctgtagcgcaactgacgctgaagctcgaaagcgtgggtatcgaacaggattagataccctggtagtccacgcggtaaacgatggatgctcgctgtttgcgtctgacgtaagcggccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgtaggcgaacgattcagagatgatgaggcccttcggggcgcctatggaggtgctgcatggttgtcgtcagctcgtgccgtgaggtgtcggcttaagtgccataacgagcgcaacccttgttcgtagttgccatcgggtgatgccgggcactctgcgaagactgcctccgtaaggagtgaggaaggtggggatgacgtcaaatcagcacggcccttacgtccggggctacacacgtgttacaatggcatgtacagaaagcggggtgtatgcaaatacgctcgaatccctaaaacatgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctaaagtccgtgaccgcgagggtcggcctagggtgaaaccggtgattggggctaagtcgtaacaaggtaacc

SEQ ID NO: 1563 - DNA, 1533 bp, Prevotella tannerae
tacaatgtagagtttgatcctggctcaggatgaacgctggctacaggcttaacacatgcaagtcgtggggcagcggatgcttagcttgctaagtatgccggcgaccggcgcacgggtgagtaacgcgtaccgaacctgcccatcacacagggataggcttgcgaaagcaagattaatactgatggtctcagttgtatgcatgtatgattgagtaaagccttcgggcggtgatggatggcggtgcgtcccattaggacgttggcggggtaacggcccaccaatccttcgatgggtaggggttctgagaggaaggtcccccacattggaactgagatacggtccaaactcctacgggaggcagcagtgaggaatattggtcaatgggcgagagcctgaaccagccaagtagcgtgcgggatgaaggcccttgtggtcgtaaaccgcttttatcagtgaataaagtgcaccacgtgtggtgtcattgcaggtagctgaagaaaaaggaccggctaattccgtgccagcagccgcggtaatacggaaggtccgggcgttatccggaattattgggtttaaagggagcgcaggcgggagtataagtcagctgttaaatatcagagcccaactctgttatgcagttgaaactatatttcttgagtacgcacagggatggcggaattcagggtgtagcggtgaaatgcttagatatcctgaagaactccgatcgcgaaggcagccatccggagcgtaactgacgctgaggctcgaaggtgcgggtatcgaacaggattagataccctggtagtccgcacggtaaacgatgaatactcgcagttcggccgtttaggtcgagttgtccagcgaaagcgttaagtattccacctggggagtacgccggcaacggtgaaactcaaaggaattgacgggggcccgcacaagcggaggaacatgtggtttaattcgatgatacgcgaggaaccttacccgggcttgaaccaagagtgcggagtgcagagatgcgctttttcttcggacacttttggaggtgctgcatggttgtcgtcagctcgtgccgtgaggtgtcggcttaagtgccataacgagcgcaacccttttctacgtttgccatcgggtaatgccgggaactccgtggatactgccgccgcaaggcggaggaaggtggggatgacgtcaaatcagcacggcccttacgtccggggctacacacgtgttacaatggtcggagcagcaggaagctacctggcgacaggatgctgatcccaaaacccggcctcagttcggactggagtctgcaacccgactccacgaagccggattcgctagtaatcgcgcatcagccatggcgcggtgaatacgttcccgggccttgtacacaccgcccgtcaagccatgaaagccgggggtgcctgaaagccgtgaccgcgagggtcggcctagggtaaaaccggtgattggggctaagtcgtaacaaggtagccgtaccggaaggtgcggctggaacacctcctttct

SEQ ID NO: 1564 - DNA, 1536 bp, Prevotella timonensis
ttacaatgtagagtttgatcctggctcaggatgaacgctagctacaggcttaacacatgcaagtcgcagggtaacatgaggaaagcttgctttccttgatgacgactggcgcacgggtgagtaacgcgtatccaaccttcccataactacgggataacccgttgaaagacggcctaataccgtatgacatcgtttgctgacatcaaataacgattaaaggtttagcggttatggatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttatgtggggataaagtgcgtgacgtgtcatgcattgcaggtaccacatgaataaggaccggctaattccgtgccagcagccgcggtaatacggaaggtccgggcgttatccggatttattgggtttaaagggagcgtaggctgtctattaagcgtgttgtgaaatttaccggctcaaccggtggcttgcagcgcgaactggtcgacttgagtatgcaggaagtaggcggaattcatggtgtagcggtgaaatgcttagatatcatgacgaactccgattgcgcaggcagcttactgtagcataactgacgctgatgctcgaaagtgcgggtatcaaacaggattagataccctggtagtccgcacggtaaacgatggatgctcgctattcgtcctatttggatgagtggccaagtgaaaacattaagcatcccacctggggagtacgccggcaacggtgaaactcaaaggaattgacgggggcccgcacaagcggaggaacatgtggtttaattcgatgatacgcgaggaaccttacccgggcttgaactgccagcgaacgatacagagatgttgaggcccttcggggcgctggtggaggtgctgcatggttgtcgtcagctcgtgccgtgaggtgtcggcttaagtgccataacgagcgcaacccttttctttagttgccatcaggtgatgctgggcactctatggatactgccaccgtaaggtgtgaggaaggtggggatgacgtcaaatcagcacggcccttacgtccggggctacacacgtgttacaatggggcatacagagtgttggcttaacgcaagtttggtctaatcttcaaagtgtctcccagttcggattggggtctgcaacccgaccccatgaagctggattcgctagtaatcgcgcatcagccatggcgcggtgaatacgttcccgggccttgtacacaccgcccgtcaagccatgaaagctgggggtgcctgaagtccgtaaccgttaaggagcggcctagggcaaaactggtgattggggctaagtcgtaacaaggtagccgtaccggaaggtgcggctggaacacctcctttct

SEQ ID NO: 1565 - DNA, 1531 bp, Prevotella veroralis
tacaatggagagtttgatcctggctcaggatgaacgctagctacaggcttaacacatgcaagtcgaggggaaacggcgttgagtgcttgcactcttcggacgtcgaccggcgcacgggtgagtaacgcgtatccaaccttcccataactaagggataacctgccgaaaggcagactaataccttatgtaattcttagatgacatcagaagagaatgaaagatttatcggttatggatggggatgcgtctgattagcttgttggtggggtaacagcccaccaaggcaacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttgtatggggataaagtcaatcacgtgtgattgtttgcaggtaccatacgaataaggaccggctaattccgtgccagcagccgcggtaatacggaaggttcgggcgttatccggatttattgggtttaaagggagcgtaggccggagattaagtgtgttgtgaaatgtagacgctcaacgtctgacttgcagcgcatactgttttccttgagtacgcacaacgttggcggaattcgtcgtgtagcggtgaaatgcttagatatgacgaagaactccgattgcgaaggcagctgacgggagcgccactgacgcttaagctcgaaggtgcgggtatcgaacaggattagataccctggtagtccgcacagtaaacgatggatgcccgctgttggtacctagtatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagaggaaggatttagagataatgacgcccttcggggtctctgtgaaggtgctgcatggttgtcgtcagctcgtgccgtgaggtgtcggcttaagtgccataacgagcgcaacccctctcttcagttgccatcaggtgatgctgggcactctggagacactgccaccgtaaggtgtgaggaaggtggggatgacgtcaaatcagcacggcccttacgtccggggctacacacgtgttacaatggccggtacagagggacggtgtaatgcaaattgcatccaatcttgaaagccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccgcaaggatcggcctagggcaaaactggtgattggggctaagtcgtaacaaggtagccgtaccggaaggtgcggctggaacacctcctt

SEQ ID NO: 1566 - DNA, 1302 bp, Prevotellaceae bacterium P4P_62 P1
gaacgctagctacaggcttaacacatgcaagtcgagggaccggcgcacgggtgcgtaacgcgtatcgaacctgccctttactcagggatagccttgcgaaagtaagattaatacctgatagttaaagttggtaaaggatggcgatgcgtctgattaggtagtaggcggggtaatggcccacctagccgacgatcagtaggggttctgagaggaaggtcccccacattggaactgagacacggtccaaactcctacgggaggcagcagtgaggaatattggtcaatggacgagagtctgaaccagccaagtagcgtgcaggatgacggcctctgggttgtaaactgcttttagttgggaacaggagtgtaccatcagaaaaaggaccggctaattccgtgccagcagccgcggtaatacggaaggtccaggcgttatccggatttattgggtttaaagggagcgtaggcggacgattaagtcagctgtgaaagtttgcggctcaaccgtaaaattgcagttgaaactggttgtcttgagtgcacgcagggatgttggaattcatggtgtagcggtgaaatgcttagatatcatgaagaactccgatcgcgaaggcatatgtccggagtgactgacgctgaggctcgaaagtgcgggtatcgaacaggattagataccctggtagtccgcacagtaaacgatgaatactcgcagtatgcgtgtatgctgccaagtgaaaacgttaagtattccacctggggagtacgccggcaacggtgaaactcaaaggaattgacgggggcccgcacaagcggaggaacatgtggtttaattcgatgatacgcgaggaaccttacccgggcttgaactatggaggtgctgcatggttgtcgtcagctcgtgccgtgaggtgtcggcttaagtgccataacgagcgcaacccttctccacgtttgccatcagctgggcactccgtggatactgccatcgtaagatggaggaaggtggggatgacgtcaaatcagcacggcccttacgtccggggctacacacgtgttacaatggccggcagagggaagccaccaggcgactgggcgctgatccattccggtctcagttcggatggagtctgcaacccgactccagaagctggattcgctagtaatcgcgcatcagccatggcgcggtgaatacgttcccgggccttgtacacaccgcccgtcaagccatgaaagccgggggtgcctgaaagctgtggcggcctagggtaaaaccggtgattggggctaagtcgtaacaaggta

SEQ ID NO: 1567 - DNA, 1465 bp, Prochlorococcus marinus
ggctcaggatgaacgctggcggcgtgcttaacacatgcaagtcgaacgaaccttcgggttagtggcggacgggtgagtaacgcgtgagaatctgccctcaggagggggataacggttggaaacgaccgctaataccccatatgcctactggtgaaacgaatttcgcctgaggatgagctcgcgtctgattagcttgttggtgaggtaatggctcaccaaggcttcgatcagtagctggtctgagaggatgatcagccacactgggactgagacacggcccagactcctacgggaggcagcagtggggaattttccgcaatgggcgaaagcctgacggagcaacgccgcgtgagggacgaaggcctctgggctgtaaacctcttttctcaaggaagaagatatgacggtacttgaggaataagccacggctaattccgtgccagcagccgcggtaatacgggagtggcaagcgttatccggaattattgggcgtaaagcgtccgcaggcggcttttcaagtctgctgttaaagcgtggagcttaactccatcatggcagtggaaactgaaaggcttgagtatggtaggggcagagggaattcccggtgtagcggtgaaatgcgtagatatcgggaagaacaccagtggcgaaggcgctctgctgggccattactgacgctcatggacgaaagccaggggagcgaaagggattagatacccctgtagtcctggccgtaaacgatgaacactaggtgtcgggggaatcgaccccttcggtgtcgtagctaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaacctcttagaaatttgagggtgccttcgggaatgcagtgacaggtggtgcatggctgtcgtcagctcgtgtcgtgagatgttgggttaagtcccgcaacgagcgcaacccacgtttttagttgccagcatttagttgggcactctagaaagaccgccggtgataaaccggaggaaggtgtggatgacgtcaagtcatcatgccccttacaccctgggctacacacgtactacaatgctacggacaaagggcagcaaactcgcgagagctagcaaatcccataaaccgtggctcagttcagatcgtaggctgcaactcgcctacgtgaagtaggaatcgctagtaatcgcaggtcagcatactgcggtgaatacgttcccgggccttgtacacaccgcccgtcacaccatggaagttggccatgcccgaagtcgttactccaacccttgtggaggaggacgccgaaggtggggctaatgactggggtgaagtcgtaacaaggtagccgtaccggaaggtgcggctggatcacctcctaa

SEQ ID NO: 1568 - DNA, 1320 bp, Propionibacteriaceae bacterium NML 02-0265
gctggcggcgtgcttaacacatgcaagtcgaacgagtggcgaacgggtgagtaacacgtgagcaacctacccttgacactggaataagcgctcgaaagggcgtctaataccggatattgaaaggcggtcaaggatgggctcgcggcctatcagctagttggtgaggtaacggctcaccaaggcttcgacgggtagccggcctgagagggcgaccggccacactgggactgagatacggcccagactcctacgggaggcagcagtggggaatattgcacaatgggcgcaagcctgatgcagcaacgccgcgtgcgggatgacggccttcgggttgtaaaccgctttcagcaccgacgatgacggtaggtgcagaagaaggaccggccaactacgtgccagcagccgcggtgatacgtagggtccgagcgttgtccggaattattgggcgtaaagagctcgtaggcggtttgtcgcgtcggaagtgaaaactcagggcttaactctgagcctgcttccgatacgggcagactagaggaagttaggggagaacggaattcctggtggagcggtggaatgcgcagatatcaggaggaacaccggtggcgaaggcggttctctgggactcctgacgctgaggagcgaaagcgtggggagcaaacaggcttagataccctggtagtccacgccgtaaacggtgggcactaggtgtgggtcgatccgtgccgtagctaacgcattaagtgccccgcctggggagtacggccgcaaggctaaaactcaaaggaattgacgggggcccgcacaagcggcggagcatgcggattaattcgatgcaacgcgaagaaccttacctgggtttgacatatacaggtggtgcatggctgtcgtcagctcgtgtcgtgagatgttgggttaagtcccgcaacgagcgcaaccctcgtcctatgttgccagcggccggggactcataggagactgccggggtcaactcggaggaaggtggggatgaggtcaagtcatcatgccccttatgtccagggcttcacgcatgctacaatggctggcaaagggctgcgaaaccgcaaggtttagcgaatcccaaccagtctcagttcggatggggtctgcaactcgaccccagaagtcggagtcgctagtaatcgcagatcagcaacgctgcggtgaatacgttcccgggccttgtacacaccgcccgtcaagtcatgaaagtcggcaacacccgaagccggtgcccagggagccgtcgaaggtggggctggtaattaggactaagtcgtaacaaggtagccgtaccggaag

SEQ ID NO: 1569 - DNA, 1522 bp, Propionibacterium acidipropionici
agagtttgatcctggctcaggacgaacgctggcggcgtgcttaacacatgcaagtcgaacggtaaggccctttcgggggtacacgagtggcgaacgggtgagtaacacgtgagtaacctgcccacttcttcgggataacgctaggaaactggtgctaataccggatatgagctttcaccgcatggtgggggttggaaagtgtttgtggtggtggatggactcgcggcctatcagcttgttggtgaggtagtggctcaccaaggcggtgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcaccaggggcgaaggcattcttttggggtgttgacggtacctggagaagaagcaccggctaactacgtgccagcagccgcggtgatacgtagggtgcgagcgttgtccggatttattgggcgtaaagggctcgtaggcggttgatcgcgtcggaagtgaaaacttggggcttaaccctgagcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcaaacaggcttagataccctggtagtccacgctgtaaacggtgggtactaggtgtggggtccattccacggattccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatggattggtaacggtcagagatggccgccccccttgtgggccggttcacaggtggtgcatggctgtcgtcagctcgtgtcgtgagatgttgggttaagtcccgcaacgagcgcaaccctcgtccactgttgccagcatttggttggggactcagtggagaccgccggggtcaactcggaggaaggtggggatgacgtcaagtcatcatgccccttatgtccagggcttcacgcatgctacaatggccggtacaaagagtggcgacatcgtgaggtggagcgaatctcagaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcccaacacgttctgcgtgggggagtcgtcgaaggtgggactggtaattaggactaagtcgtaacaaggtagccgtaccggaaggtgcggctggatcacct

SEQ ID NO: 1570 - DNA, 1326 bp, Propionibacterium acnes
  modified_base (46)..(46): a, c, t, g, unknown or other
  modified_base (1301)..(1301): a, c, t, g, unknown or other
  modified_base (1316)..(1316): a, c, t, g, unknown or other
  modified_base (1320)..(1320): a, c, t, g, unknown or other
gtgagtaacacgtgagtaacctgcccttgactttgggataacttcnggaaactggggctaataccggataggagctcctgctgcatggtgggggttggaaagtttcggcggttggggatggactcgcggcttatcagcttgttggtggggtagtggcttaccagggctttgacgggtagccggcctgagagggtgaccggccacattgggactgagatacggcccagactcctacgggaggcagcagtggggaatattgcacaatgggcggaagcctgatgcatcaacgccgcgtgcgggatgacggccttcgggtgtaaccgctttcgctgtgacgaagcgtgagtgacgtatgggtagaagcaccggctaactacgtgccagcaccgcggtgatactagggtgcgagcgttgtccggatttattgggcgtaaagggctgtaggtggttgatcgcgtcggaagtgtaatcttggggcttaaccctgagcgtgctttcatacgggttgacttgaggaaggtaggggagaatggaattcctggtggagcggtggaatgcgcaatatcagaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgcgccgtaactaacgctttaagtaccccgcctggggagtacggccgcaaggctaaacctcaaaggaattgacggggccccgcacaagcggcggagcatgcggattaattcgatgcaacgcgtataaccttggatgggtttgacatggatcgggagtgctcaaagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccgntggcctaaccgttgngggngagccg

SEQ ID NO: 1571 - DNA, 1500 bp, Propionibacterium avidum
tcaggacgaacgctggcggcgtgcttaacacatgcaagtcgaacggaaagggccttcgggggtactcgagtggcgaacgggtgagtaacacgtgagtaacctgcccttgacttcgggataacttcaggaaactggggctaataccggataggaatccttgctgcatggtgggggttggaaagcttcggcggttttggatggactcgcggcttatcagcttgttggtggggtagtggcttaccaaggctttgacgggtagccggcctgagagggcgaccggccacattgggactgagatacggcccagactcctacgggaggcagcagtggggaatattgcacaatgggcggaagcctgatgcagcaacgccgcgtgcgggatgacggccttcgggttgtaaaccgctttcagcaggggcgaacttgtggtgacggtacctgcagaagaagcaccggctaactacgtgccagcagccgcggtgatacgtagggtgcgagcgttgtccggatttattgggcgtaaagagctcgtaggtggttgattgcgtcggaagtgaaaacttggggcttaaccctgagcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcgaacaggcttagataccctgggtagtccacgctgtaaacggtgggtactaggtgtggggtccattccacggattccgtgccgtagctaacgcattaagtaccccgcctggggagtacggccgcaaggtaaaactcaaaggaattgacggggccccgcacaagcggcggagcatgcggattaattcgatgcaacgcgaagaaccttacctgggtttgacatggactgggagtgctcagagatgggtatgcctccttgtggggctggttcacaggtggtgcatggctgtcgtcagctcgtgtcgtgagatgttgggttaagtcccgcaacgagcgcaaccctcgttcactgttgccagcacgttatggtggggactcagtggagaccgccggggtcaactcggaggaaggtggggatgacgtcaagtcatcatgccccttatgtccagggcttcacgcatgctacaatggccggtacaaagagttgcgagcctgtgagggtgagcgaatctcggaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcctaacctgtgtgggggagccgtcgaaggtgggactggtaattaggactaagtcgtaacaaggtagccgtaccggaaggtgcggctggatcacctcctttct

SEQ ID NO: 1572 - DNA, 1510 bp, Propionibacterium freudenreichii
agtttgatcctggctcaggacgaacgctggcggcgtgcttaacacatgcaagtcggacggtaaggcccctttcggggggtacacgagtggcgaacgggtgagtaacacgtgaggaacgtgcccttgacttcggtatagctccaggaaactggtggtaatcccgaatatgagcctggcctgcatgggttgggttggaaagctttatgcggtcagggatcgtctcgcggcctatcagcttgttggtggggtaatggcctaccaaggcagcgacgggtagccggcctgagagggtgaccggccacattgggactgagatacggcccagactcctacgggaggcagcagtggggaatattgcacaatgggcgcaagcctgatgcagcaacgccgcgtgcgggatgacggccttcgggttgtaaaccgctttcatccatgacgaagcgcaagtgacggtagtgggagaagaagcaccggctaactacgtgccagcagccgcggtgatacgtagggtgcgagcgttgtccggaattattgggcgtaaagagcttgtaggcggttgatcacgtcggaagtgaaattccagggcttaactctgggcttgctttcgatacgggttgacttgaggaatgtaggggagaatggaactctcggtggagcggtggaatgcgcagatatcgggaagaacaccagtggcgaaggcggttctctggacatttcctgacgctgagaagcgaaagcgtggggagcaaacaggcttagataccctggtagtccacgccgtaaacggtgggtactaggtgtgggtcccttccacggggtccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatgtactggaagcgttcagagatgggcgtgcctttttggctggtacacaggtggtgcatggctgtcgtcagctcgtgtcgtgagatgttgggttaagtcccgcaacgagcgcaaccctcgtccaatgttgccagcagttcggctggggactcattggagaccgccggggccaactcggaggaaggtggggatgaggtcaagtcatcatgccccttatgtccagggcttcacgcatgctacaatggccggtacaaagagttgcgagcctgtgagggtgagcgaatctcagaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcccaaccttttggggggagccgtcgaaggtgggactggtgattaggactaagtcgtaacaaggtagccgtaccggaaggtgcggctggatcacctccttt

SEQ ID NO: 1573 - DNA, 1442 bp, Propionibacterium granulosum
tgatcatggctcaggacgaacgctggcggcgtgcttaacacatgcaagtcgtacggtaaggccctttcgggggtacacgagtggcgaacgggtgagtaacacgtgagtaacctgcccacaactttgggataacgctaggaaactggtgctaatactggatatgtgctcctgctgcatggtgggggttggaaagctccggcggttgtggatggactcgcggcctatcagcttgttggtggggtagtggcctaccaaggcggcgacgggtagccggcctgagagggtgaccggccacattgggactgagatacggcccagactcctacgggaggcagcagtggggaatattgcacaatgggcgcaagcctgatgcagcaacgccgcgtgcgggatgacggccttcgggttgtaaaccgctttcagcagggacgaagctttttgtgacggtacctgcagaagaagcaccggctaactacgtgccagcagccgcggtgatacgtagggtgcgagcgttgtccggatttattgggcgtaaagggctcgtaggcggttgatcgcgtcggaagtggaaacttgatgcttaacgttgagcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcgaacaggcttagataccctggtagtccacgctgtaaacggtgggtactaggtgtggggtccattccacggattctgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatggatcggaagcttccagagatggttgtgcctcttttggggtcggttcacaggtggtgcatggctgtcgtcagctcgtgtcgtgagatgttgggttaagtcccgcaacgagcgcaaccctcgtccactgttgccagcaattcggttggggactcagtggagaccgccggggtcaactcggaggaaggtggggatgacgtcaagtcatcatgccccttatgtccagggcttcacgcatgctacaatggccggtacagtgagttgcgacatcgtaaggtggagcgaatctcaaaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagtcggtaacactcgaagccggtggcctaacactttttgtgggggagctgtcgaaggtg

SEQ ID NO: 1574 - DNA, 1487 bp, Propionibacterium jensenii
agttttgattcctgggcttcaaggaacgaaaccgctgggtggcgttgcttaaccctgcaaagtcggaaccgggttaaggccccttttgggggggttaccacgaagtggcgaaccgggttgagtaaacaccgtggagttaacccttccccattccactttcgggattaacgctagggaaacctggtggctaaattcccggatatgagctctcatcgccatggtgggggttggaaagttctggcggtggtggatggactcgcgtcctatcagcttgttggtgaggttgtggctcaccaaggcgtcgacgggtagccggcctgagagggtgaccggccacattgggactgagatacggcccagactcctacgggaggcagcagtggggaatattgcacaatgggcgcaagcctgatgcagcaacgccgcgtgcgggatgacggccttcgggttgtaaaccgctttcaccagggacgaagtgcctttcggggtgtgacggtacctggagaagaagcaccggctaactacgtgccagcagccgcggtgatacgtagggtgcgagcgttgtccggatttattgggcgtaaagagctcgtaggtggttgatcacgtcggaagtgaaaacttggggcttaaccctgggcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcaaacaggcttagataccctggtagtccacgctgtaaacggtgggtactaggtgtggggtccattccacggattccgtgccgtagctaacgcattaagtaccccgcctggggagtacggccgcaggctaaactcaaaggaattgacggggccccgcacaagcggcggagcatgcggattaattcgatgcaacgcgaagaaccttacctgggtttgacatggattggtaacggtcagagatggccgccccccttgtgggccgattcacaggtggtgcatggctgtcgtcagctcgtgtcgtgagatgttgggttaagtcccgcaacgagcgcaaccctcgtccactgttgccagcaattcggttggggactcagtggagaccgccggggtcaactcggaggaaggtggggatgacgacaagtcatcatgccccttatgtccagggcttcacgcatgctacaatggctggtacaaagagttgcgacactgtgaggtggagcgaatctcaaaaagccagtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcccaaccttttgggggggagccgtccaaggtgg

SEQ ID NO: 1575 - DNA, 1506 bp, Propionibacterium propionicum
tcaggacgaacgctggcggcgtgcttaacacatgcaagtcgaacggaaaggcccctttgggggtactcgagtggcgaacgggtgagtaacacgtgagtaacctgcccttgacttcgggataacttcaggaaactggggctaataccggatagacatccttgctgcatggtgggggttggaaagcttcggcggttttggatggactcgcggcttatcagcttgttggtggggtagtggcttaccaaggctttgacgggtagccggcctgagagggcgaccggccacattgggactgagatacggcccagactcctacgggaggcagcagtggggaatattgcacaatgggcggaagcctgatgcagcaacgccgcgtgcgggatgacggcttcgggttgtaaacccgctttcagcaggggcgaagcttttgtgacggtacctgcagaagaagcaccggctaactacgtgccagcagccgcggtgatacgtagggtgcgagcgttgtccggatttattgggcgtaaagagctcgtaggtggttgattgcgtcggaagtgaaaacttggggcttaaccctgagcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcgaacaggcttagataccctgggtagtccacgctgtaaacggtgggtactaggtgtggggtccattccacggattccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatggactgggagtgctcagagatgggtatgcctccttgtggggctggttcacaggtggtgcatggctgtcgtcagctcgtgtcgtgagatgttgggttaagtcccgcaacgagcgcaaccctcgttcactgttgccagcacgttatggtggggactcagtggagaccgccggggtcaactcggaggaaggtggggatgacgtcaagtcatcatgccccttatgtccagggcttcacgcatgctacaatggccggtacaaagagttgcgagcctgtgagggtgagcgaatctcggaaagccggtctcagttcggattggggtctgcaactcgaccctatgaagtcggagtcgctagtaatcgcagatcagcaacgctgcggtgaatacgttcccggggcttgtacacaccgcccgtcaagtcatgaaagtcggtaacacccgaagccggtggcctaacctgtgtgggggagccgtcgaaggtgggactggtaattaggactaagtcgtaacaaggtagccgtaccggaaggtgcggctggatcacctcctttctaagg

SEQ ID NO: 1576 - DNA, 1530 bp, Propionibacterium sp.
  434-HC2
tttcattggagagtttgatcctggctcaggacgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggccggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctttct

SEQ ID NO: 1577 - DNA, 1367 bp, Propionibacterium sp.
  H456
gagtttgatcctggctcaggacgaacgctggcggcgtgcttaacacatgcaagtcgaacgagtggcgaacgggtgagtaacacgtgagtaacctgcccttgacttcgggataacttcaggaaactggggctaataccggatagggaaaggcggttttggatggactcgcggcttatcagcttgttggtggggtagtggcttaccaaggctttgacgggtagccggcctgagagggcgaccggccacattgggactgagatacggcccagactcctacgggaggcagcagtggggaatattgcacaatgggcggaagcctgatgcagcaacgccgcgtgcgggatgacggccttcgggttgtaaaccgctttcagcaggggcgatgacggtacctgcagaagaagcaccggctaactacgtgccagcagccgcggtgatacgtagggtgcgagcgttgtccggatttattgggcgtaaagagctcgtaggtggttgattgcgtcggaagtgaaaacttggggcttaaccctgagcgtgctttcgatacgggttgacttgaggaaggtaggggagaatggaattcctggtggagcggtggaatgcgcagatatcaggaggaacaccagtggcgaaggcggttctctggacctcctgacgctgaggagcgaaagcgtggggagcgaacaggcttagataccctggtagtccacgctgtaaacggtgggtactaggtgtggggtattccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatgcacaggtggtgcatggctgtcgtcagctcgtgtcgtgagatgttgggttaagtcccgcaacgagcgcaaccctcgttcactgttgccagcaygtggggactcagtggagaccgccggggtcaactcggaggaaggtggggatgacgtcaagtcatcatgccccttatgtccagggcttcacgcatgctacaatggccggcaaagagttgcgagcctgtgagggtgagcgaatctcggccggtctcagttcggatggggtctgcaactcgaccctagaagtcggagtcgctagtaatcgcagatcagcaacgctgcggtgaatacgttcccggggcttgtacacaccgcccgtcaagtcatgaaagtcggtaacacccgaagccggtgcctagggagccgtcgaaggtgggactggtaattaggactaagtcgtaacaaggtagccgtaccggaaggtgcggctggatcacctcctt

SEQ ID NO: 1578 - DNA, 966 bp, Propionibacterium sp.
  LG
  modified_base (876)..(876): a, c, t, g, unknown or other
  modified_base (900)..(900): a, c, t, g, unknown or other
  modified_base (914)..(914): a, c, t, g, unknown or other
  modified_base (947)..(949): a, c, t, g, unknown or other
ttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtanaaccttacctgggtttgacatggntcgggagtgctcanagatgggtgtgcctcttttggggtcggttcacnnnggtgcatggctgtcgtc

SEQ ID NO: 1579 - DNA, 1359 bp, Propionibacterium sp.
  S555a
  modified_base (574)..(574): a, c, t, g, unknown or other
aaggccctgcttttgtggggtgctcgagtggcgaacgggtgagtacacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgttaaagggctcgtaggtggtggatcgcgtcggaagtgtaatcttggcggcttaaccctgagcgtgctttcgacacgggttgacttgaggaaggtangggagaatggaattcctggtggagcggtggaatgcgcagatatcaggaggaacaccagtggcgaaggcgttctctgggcctttcctgacgctgaggagcgaaagcgtggggagcgaacaggcttagataccctggtagtccacgctgtaaacggtgggtactaggtgtggggtccattccacgggttccgtgccgtactaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggccta

SEQ ID NO: 1580 - DNA, 1494 bp, Propionibacterium sp.
  oral taxon 192
gagtttgatcctggctcaggacgaacgctggcggcgtgcttaacacatgcaagtcgaacggtaaggccctttcgggggtacacgagtggcgaacgggtgagtaacacgtgagtaacctgcccctgactttgggataacggatggaaacgtttgctaataccggatattcagctcttgaggcatcttttgggttggaaagttttttcggttggggatgggctcgcgtcctatcagcttgttgttggggtagtggcctaccaaggcgtcgacgggtagccggcctgagagggcgaccggccacattgggactgagatacggcccagactcctacgggaggcagcagtggggaatattgcacaatggacggaagtctgatgcagcaacgccgcgtgcgggatgacggccttcgggttgtaaaccgctttcagccatgacgaagcgtgagtgacggtagtggtagaagaagcaccggctaactacgtgccagcagccgcggtgatacgtagggtgcgagcgttgtccggatttattgggcgtaaagagcttgtaggcggttgattgcgtcgaaagtgcaaactcagggcttaactctgagcctgctttcgatacgggttgacttgagggatgtaggggagaatggaattcccggtggagcggtggaatgcgcagatatcgggaggaacaccagtggcgaaggcggttctctggacatttcctgacgctgagaagcgaaagcgtggggagcaaacaggcttagataccctggtagtccacgctgtaaacggtgggcattaggtgtgggtcacattccacgtggtctgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatatgccggaagcatgcagagatgtgtgtgcctttttggtcggtttacaggtggtgcatggctgtcgtcagctcgtgtcgtgagatgttgggttaagtcccgcaacgagcgcaaccctcgtccaatgttgccagcacgttatggtggggactcattggagaccgccggggtcaactcggaggaaggtggggatgacgtcaagtcatcatgccccttatgtccagggcttcacgcatgctacaatggccggtacaaagagttgcgagcctgtgagggtgagcgaatctcataaagccggtctcagttcggattggggtctgcaactcgaccccatgaagtcggagtcgctagtaatcgcagatcagcaatgctgcggtgaatacgttctcggggcttgtacacaccgcccgtcaagtcatgaaagttggtaacacccgaagccggtggcctaacctttgtggggggagccgtcgaaggtgggactggtaattaggactaagtcgtaacaaggtagccgtaccggaaggtgc

SEQ ID NO: 1581 - DNA, 1467 bp, Propionibacterium thoenii
agttttgatcctggctcaggacgaaacgctggcggcgtgcttaacacatgcaattcgaacggtaaggcccttttcgggggtacaacgagtggccaacgggtgagtaacacgtgagtaaccctgcccatcacttcgggataacgctgggaaactggtgctaataccggatatgagctcctgctgcatggtgggggttggaaagtttttgcggtggtggatggactcgcgtcctatcagcttgttggtgaggttgtggctcaccaaggcgtcgacgggtagccggcctgagagggtgaccggccacattgggactgagatacggcccagactcctacgggaggcagcagtggggaatattgcacaatgggcgaaagcctgatgcagcaacgccgcgtgcgggatgacggccttcgggttgtaaaccgctttcaccagggacgaagggcctttcggggtttgacggtacctggagaagaagcaccggctaactacgtgccagcagccgcggtgatacgtagggtgcgagcgttgtccggatttattgggcgtaaagagctcgtaggtggttgatcgcgtcggaagtgaaaacttggggcttaaccctgggcgtgctttcgatacgggttgacttgtggaaggtaggggagaatggaattcttggtggagcggtggaatgcgcagatatcaggaggaacaccagtggcgaaggcggttctctggacctttcctgacgctgaggagcgaaagcgtggggagcaaacaggcttagataccctggtagtccacgctgtaaacggtgggtactaggtgtggggtccattccacggattccgttacgtagctattcgcttaagataccccgcctggggagtacggccgcaggctaaaactcaaaggaattgacggggccccgcacaagcggcggagcatgcggattaattcgatgcaacgcgaagaaccttacctgggtttgacatggattggtaacggtcagagatggccgccccccttgtgggccgattcacaggtggtgcatggctgtcgtcagctcgtgtcgtgagatgttgggttaagtcccgcaacgagcgcaaccctcgtccactgttgccagcaattcggttggggactcagctggagaccgccggggtcaactcggaggaaggtgggcaatgacgcacaagtcatcatgccccttatgtccagggcttcacgcatgctacaatggccggtacaaacagttgcgacactgtgaggtggagcgaatctcaaaaagccggtctcagttcggattggggtctgcaactcaaccccatgaagtcggagtcgctagtaatcgcagatcagcaacgctgcggtgaatacgttcccggggcttgtacacaccgcccgtcaagtcatgaaagtcagtaacacccttgagcgggtggccctacccttgtgggggggccgtcgaaggtggactggttc

SEQ ID NO: 1582 - DNA, 1401 bp, Proteus mirabilis
tcgagcggtaacaggagaaagcttgctttcttgctgacgagcggcggacgggtgagtaatgtatggggatctgcccgatagagggggataactactggaaacggtggctaataccgcataatgtctacggaccaaagcaggggctcttcggaccttgcactatcggatgaacccatatgggattagctagtaggtggggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaggttaatacccttgtcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcg

SEQ ID NO: 1583 - DNA, 1402 bp, Proteus penneri
tcgagcggtaacagaagaaagcttgctttcttgctgacgagcggcggacgggtgagtaatgtatggggatctgcccgatagagggggataactactggaaacggtggctaataccgcatgacgtctacggaccaaagcaggggctcttcggaccttgcgctatcggatgaacccatatgggattagctagtaggtgaggtaatggctcacctaggcaacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaagttaatacctttgtcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccacgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaagcttacctactcttgacttccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcgcgtaatggcgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgc

SEQ ID NO: 1584 - DNA, 1374 bp, Proteus sp.
  HS7514
gagcggcggacgggtgagtaatgtatggggatctgcccgatagagggggataactactggaaacggtggctaataccgcataatgtctacggaccaaagcaggggctcttcggaccttgcactatcggatgaacccatatgggattagctagtaggtggggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaggttaatacccttgtcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcacgtcatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccacttt

SEQ ID NO: 1585 - DNA, 1495 bp, Proteus vulgaris
gattgaacgctggcggcaggcctaacacatgcaagtcgagcggtaacagaggaaagcttgctttcttgctgacgagcggcggacgggtgagtaatgtatggggatctgcccgatagagggggataactactggaaacggtagctaataccgcatgacgtctacggaccaaagcaggggctcttcggaccttgcgctatcggatgaacccatatgggattagctagtaggtgaggtaatggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgttaagattaatactcttagcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccacgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatcctttagagatagaggagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcctaacaaggtaaccgtaggggaac

SEQ ID NO: 1586 - DNA, 1397 bp, Providencia alcalifaciens
gtcgagcggtaacaggggaagcttgcttctcgctgacgagcggcggacgggtgagtaatgtatggggatctgcccgatagagggggataactactggaaacggtagctaataccgcataatctcttaggagcaaagcaggggaacttcggtccttgcgctatcggatgaacccatatgggattagctagttggtgaggtaatggctcaccaaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagttgggaggaaggcgttgatgctaatatcatcaacgattgacgttaccaacagaagaagcaccggctaactccgtgccagcagccgcggtaatacggagggtgcaagcgttaatcggaattactgggcgtaaagcgcacgcaggcggttgattaagttagatgtgaaatccccgggcttaacctgggaatggcatctaagactgtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgttcccttgaggagtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggaactcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggc

SEQ ID NO: 1587 - DNA, 1391 bp, Providencia rettgeri
  modified_base (939)..(939): a, c, t, g, unknown or other
  modified_base (956)..(956): a, c, t, g, unknown or other
  modified_base (1113)..(1113): a, c, t, g, unknown or other
  modified_base (1380)..(1380): a, c, t, g, unknown or other
gcggtaacaggggaagcttgcttctcgctgacgagcggcggacgggtgagtaatgtatggggatctgcccgatagagggggataactactggaaacggtagctaataccgcataatctctcaggagcaaagcaggggaacttcggtccttgcgctatcggatgaacccatatgggattagctagtaggtgaggtaatggctcacctaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccctagggttgtaaagtactttcagtcgggaggaaggcgttgatgctaatatcatcaacgattgacgttaccgacagaagaagcaccggctaactccgtgccagcagccgcggtaatacggagggtgcaagcgttaatcggaattactgggcgtaaagcgcacgcaggcggttgattaagttagatgtgaaatccccgggcttaacctgggaatggcatctaagactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttgaaggttgttcccttgaggagtggctttcggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaanttagcagagatgctttngtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggagganggtggggatgacgtcaagtcatcatggcccttacgagtagggctacacacgtgctacaatggcgtatacaaagagaagcgacctcgcgagagcaagcggaactcataaagtrcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttanccttcgggagg

SEQ ID NO: 1588 - DNA, 1516 bp, Providencia rustigianii
ttgatcctggctcagattgaacgctggcggcaggcctaacacatgcaagtcgagcggtaacaggggaagcttgcttctcgctgacgagcggcggacgggtgagtaatgtatggggatctgcccgatagagggggataactactggaaacggtagctaataccgcataatctctttggagcaaagcaggggaacttcggtccttgcgctatcggatgaacccatatgggattagctagttggtggggtaatggctcaccaaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagttgggaggaaggcgttgatgctaatatcatcaacgattgacgttaccaacagaagaagcaccggctaactccgtgccagcagccgcggtaatacggagggtgcaagcgttaatcggaattactgggcgtaaagcgcacgcaggcggttgattaagttagatgtgaaatccccgggcttaacctgggaatggcatctaagactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgttcccttgaggagtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatcctttgttgccagcacgtcatggtgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggaactcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggctg

SEQ ID NO: 1589 - DNA, 1494 bp, Providencia stuartii
tgatcctggctcagattgaacgctggcggcaggcctaacacatgcaagtcgagcggtaacaggggaagcttgcttctcgctgacgagcggcggacgggtgagtaatgtatggggatctgcccgatagagggggataactactggaaacggtggctaataccgcataatctcttaggagcaaagcaggggaccttagggccttgcgctgtcggatgaacccatatgggattagctagtaggtaaggtaatggcttacctaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccctagggttgtaaagtactttcagtcgggaggaaggcgttgatgttaataccatcaacgattgacgttaccgacagaagaagcaccggctaactccgtgccagcagccgcggtaatacggagggtgcaagcgttaatcggaattactgggcgtaaagcgcacgcaggcggttaattaagttagatgtgaaatccccgggcttaacctgggaatggcatctaagactggttagctagagtcttgtagaggggggtagaattccatgtgtagcggtgaaatgcgtagagatgtggaggaataccggtggcgaaggcggccccctggacaaagacttacgctcaggtgcgaaagcgtggggagcaaacaggattagataccctggtagtccacgctgtaaacgatgtcgatttggaggttgttccctagaggagtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggagctctgagacaggtgctgcatggctgtcgtcaactcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggaactcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgatccatgactggggtgaagtcgtaacaaggtagc

SEQ ID NO: 1590 - DNA, 1445 bp, Pseudoclavibacter sp.
  Timone
gacgaacgctggcggcgtgcttaacacatgcaagtcgaacgatgaagccttagcttgctttggtggattagtggcgaacgggtgagtaacacgtgagcaacgtgcccaggactctggaataaccgcgggaaaccgtggctaataccggataggtgccgaggccgcatggtcttcggttggaaagtttttgcggttctggatcggctcacggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcaacgccgcgtgggggatgacggccttcgggttgtaaacctcttttagtagggaagaagcgcaagtgacggtacctgcagaaaaagcaccggctaactacgtgccagcagccgcggtaatacgtagggtgcaagcgttgtccggatttattgggcgtaaagagctcgtaggcggtttgtcgcgtctgctgtgaaagcccgaggctcaacctcgggtctgcagtgggtacgggcaggctagagtgcggtaggggagattggaattcctggtgtagcggtggaatgcgcagatatcaggaggaacaccgatggcgaaggcagatctctgggccgttactgacgctgaggagcgaaagcatggggagcgaacaggattagataccctggtagtccatgccgtaaacgttgggcgctagatgtggggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatatatcggaatcggctagagatagtcgcgccctttgggtcggtatacaggtggtgcatggttgtcgtcagctcgtgtcgtgagatgttcggttaagtccggcaacgagcgcaacccttgtcctatgttrccagcacgttatggtgggaactcatgggatactgccgtggtcaacacggaggaaggtggggatgacgtcaaatcatcatgccccttatgtcttgggcttcacgcatgctacaatggccggtacaatgggctgcgataccgcgaggtggagcgaatcccaaaaagccggtctcagttcggattggggtctgcaactcgaccccatgaagtcggagtcgctagtaatcgcagatcagcattgctgcggtgaatacgttcccgggccttgtacacaccgcccgtcaagtcatgaaagtcggtaacacccgaagccggtggcctaaccttttggggggagctgtcgaaggtgggatcggtgattaggact

SEQ ID NO: 1591 - DNA, 1385 bp, Pseudoflavonifractor capillosus
tcgaacggagtgctcatgacggagttttcggacaacggattgggttacttagtggcggacgggtgagtaacgcgtgaggaacctgcctcggagtggggaataacacaccgaaaggtgtgctaataccgcataatgcagttgggtcgcatgactctgactgccaaagatttatcgctctgagatggcctcgcgtctgattagctagttggcggggtaacggcccaccaaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcagggacgaaacaaatgacggtacctgacgaataagccacggctaactacgtgccagcagccgcggtaatacgtaggtggcaagcgttatccggatttactgggtgtaaagggcgtgtaggcgggactgcaagtcaggtgtgaaaaccaggggctcaacctctggcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggactgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcctactaacgaagcagagatgcattaggtgcccttcggggaaagtagagacaggtggagcatgggagtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggccacacacgtactacaatggtggttaacagagggaagcaataccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaagga

SEQ ID NO: 1592 - DNA, 1382 bp, Pseudomonas aeruginosa
tcgagcggatgaagggagcttgctcctggattcagcggcggacgggtgagtaatgcctgggaatctgcctggtagtgggggataacgtccggaaacgggcgctaataccgcatacgtcctgagggagaaagtgggggatcttcggacctcacgctatcagatgagcctaggtcggattagctagttggtggggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtagttaataccttgctgttttgacgttaccaacagaataagcaccggctaacttcgtgccagcagccgcggtaatacgaagggtgcaagcgttaatcggaattactgggcgtaaagcgcgcgtaggtggttcagcaagttggatgtgaaatccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggatccttgagatcttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacctcgggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccg

SEQ ID NO: 1593 - DNA, 851 bp, Pseudomonas fluorescens
  modified_base (25)..(31): a, c, t, g, unknown or other
  modified_base (557)..(557): a, c, t, g, unknown or other
  modified_base (669)..(669): a, c, t, g, unknown or other
  modified_base (783)..(784): a, c, t, g, unknown or other
  modified_base (810)..(810): a, c, t, g, unknown or other
  modified_base (814)..(814): a, c, t, g, unknown or other
  modified_base (830)..(830): a, c, t, g, unknown or other
  modified_base (841)..(841): a, c, t, g, unknown or other
tctcttgagagcggcggacgggtgnnnnnnncctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcnagctagagtatggtagagggtggtggaatttcctgtgtagcggtgaaatgcgtagatataggaaggaacaccagtggcgaaggcgaccacctggactgatactgacactgangtgcgaaaagcgtggggagcaaacaggattagataccctggtagtccacgccgtaaacgatgtcaactagccgttgggagccttgagctcttagtggcgcagctaacgcattannttgaccgcctggggagtacggccgcnaggntaaaactcaaatgaanttgacgggggnccgcacaagc

SEQ ID NO: 1594 - DNA, 1466 bp, Pseudomonas gessardii
agattgaacgctggcggcaggcctaacacatgcaagtcgagcggtagagagaagctttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttagttaagttggatgtgaaatccccgggctcaacctgggaactgcattcaaaactgactgactagagtatggtagaggggggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggcaggacggttaccacggtgtgattcatgactggggtgaagt

SEQ ID NO: 1595 - DNA, 1537 bp, Pseudomonas mendocina
tgaactgaagagtttgatcatggctcagattgaacgctggcggcaggcctaacacatgcaagtcgagcggatgaggggagcttgctccctgatttagcggcggacgggtgagtaatgtctaggaatctgcctggtagtgggggataacgttccgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccaacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacctcgggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctcctta

SEQ ID NO: 1596 - DNA, 1517 bp, Pseudomonas monteilii
atcctggctcagattgaacgctgcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctc

SEQ ID NO: 1597 - DNA, 1348 bp, Pseudomonas poae
cttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagcta

SEQ ID NO: 1598 - DNA, 1492 bp, Pseudomonas pseudoalcaligenes
attgaacgctggcggcaggcctaacacatgcaagtcgagcggatgaagggagcttgctccctgatttagcggcggacgggtgagtaatgcctaggaatctgcctggtagtgggggataacgttccgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgc

SEQ ID NO: 1599 - DNA, 1394 bp, Pseudomonas putida
  modified_base (1384)..(1384): a, c, t, g, unknown or other
tcgagcggatgagaagagcttgctcttcgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccntcgggaggac

SEQ ID NO: 1600 - DNA, 1524 bp, Pseudomonas sp.
  2_1_26
agagtttgatcatggctcagattgaacgctggcggcaggcctaacacatgcaagtcgagcggatgaagggagcttgctcctgaattcagcggcggacgggtgagtaatgcctaggaatctgcctgatagtgggggataacgtccggaaacgggcgctaataccgcatacgtcctgagggagaaagtgggggatcttcggacctcacgctatcagatgagcctaggtcggattagctagttggtggggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccaacagaataagcaccggctaacttcgtgccagcagccgcggtaatacgaagggtgcaagcgttaatcggaattactgggcgtaaagcgcgcgtaggtggttcagcaagttggatgtgaaatccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggatccttgagatcttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacctcgggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccgcaagggggacggttaccacggagtgattcatgactggggtgaagtcgtaacaaggtagccgtaggggaacctgcggctggatcacct

SEQ ID NO: 1601 - DNA, 1284 bp, Pseudomonas sp.
  G1229
cctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgattacgttcccgggccttgtacacaccgcccg

SEQ ID NO: 1602 - DNA, 1402 bp, Pseudomonas sp.
  NP522b
catgcaagtcgagcggatgaagggagcttgcttctggattcagcggcggacgggtgagtaatgcctaggaatctgcctggtagtgggggacaacgttccgaaaggagcgctaataccgcatacgtcctacgggagaaagtgggggatcttcggacctcacgctatcagatgagcctaggtcggattagctagtaggtggggtaatggctcacctaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccaacagaataagcaccggctaacttcgtgccagcagccgcggtaatacgaagggtgcaagcgttaatcggaattactgggcgtaaagcgcgcgtaggtggtttggtaagatggatgtgaaatccccgggctcaacctgggaactgcatccataactgcctgactagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggatccttgagatcttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgtccggaatcctgcagagatgcgggagtgccttcgggaatcggaacacaggtgctgcatggctgtcgtcagctcgtgtcgtggagatgttgggttaagtcccgtaacgagcgcaccctttgtccttagttaccagcacgttatggtgggcactctaaggagactgccggtgacaaaccggaggaaggtggggatgaggtcaagtcatcatggcccttacggccagggctacacacgtgctacaatggtcggttcagagggttgccaagccgcgaggtggagctaatcccagaaaaccgattgtagtccggatcgcagtctgcaactcgactgcggaagtcggaatcgctagtaatcgtgaatcagaatgtcacggtgaatacgttcccgggccttgtacactccgcccgtcacaccatgggagtgggttgctccagaagtagctagtctaaccgcaagggggac

SEQ ID NO: 1603 - DNA, 1363 bp, Pseudomonas stutzeri
gcttgctctctgattcagcggcggacgggtgagtaatgcctaggaatctgcctgrtagtgggggacaacgtttcgaaaggaacgctaataccgcatacgtcctacgggagaaagcaggggaccttcgggccttgcgctatcagatgagcctaggtcggattagctagttggtgaggtaacggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaacttcgtgccagcagccgcggtaatacgaagggtgcaagcgttaatcggaattactgggcgtaaagcgcgcgtaggtggtttgttaagttgaatgtgaaagccccgggctcaacctgggaactgcatccaaaactggcaagctagagtatggcagagggtggtggaatttcctgtgtagcggtgaaatgcgtagatataggaaggaacaccagtggcgaaggcgaccacctgggctaatactgacactgaggtgcgaaagcgtggggagcaaacaggattagataccctggtagtccacgccgtaaacgatgtcgactagccgttgggatccttgagatcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtcta

SEQ ID NO: 1604 - DNA, 1450 bp, Pseudomonas tolaasii
agagtttgatcctggctcagattgaacgctggcggcaggcctaacacatgcaagtcgagcggtagagagaagcttgcttctcttgagagcggcggacgggtgagtaatgcctaggaatctgcctggtagtgggggataacgtccggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttgcctaatacgtaactgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacsggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacaaaccgcccgtcacaccatgggagtgggttgcaccagaagtagctagtctaaccttcgggaggacgg

SEQ ID NO: 1605 - DNA, 1439 bp, Pseudomonas viridiflava
tgcgagtcgatcggtagagagaagcttgcttctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaacctaatacgttattgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaatcctttagagatagaggagtgccttcgggagcattgagacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccgcggtgtgattcatgactggggtgaagtcgaa

SEQ ID NO: 1606 - DNA, 1480 bp, Pseudoramibacter alactolyticus
taagtcaaaaagaacagtttgatcatggctcaggacgaacgctggcggtatgcttaacacatgcaagtcgaacgagaagttttttattgaccttcgggggatataagagacagacagtggcgaacgggtgagtaacgcgtgggcaacctacctatcggagcgggatagcctcgagaaatcgggagtaaaaccgcataacacagcagaatcgcatgactttgctgtcaaaactccggtgccgatagatgggcccgcgtctgattagctagttggtaaggtaagggcttaccaaggcaacgatcagtagccggtctgagagggcgaacggccacactggaactgagacacggtccagactcctacgggaggcagcagtggggaatattgcgcaatgggggcaaccctgacgcagcaataccgcgtgagtgaagaaggttttcggatcgtaaagctctgttattggggaagaagcagtgacggtacccaatgaggaagtcccggctaactacgtgccagcagccgcggtaatacgtaggggacgagcgttgtccggaatcactgggcgtaaagggcgcgtaggcggttttataagtcagatgtgaaaggtaccggctcaaccggtgacgtgcatttgaaactgtaagacttgagtactgaagaggcaagcggaattcctagtgtagcggtgaaatgcgtagatattaggaagaacaccggtggcgaaggcggcttgctgggcagatactgacgctgaggtgcgaaagcgtggggagcgaacaggattagataccctggtagtccacgccgtaaacgatgaatactaggtgttggcgaataagtcagtgccggagttaacacaataagtattccgcctggggagtacgaccgcaaggttgaaactcaaaggaattgacggggacccgcacaagcagcggagcatgtggtttaattcgaagcaacgcgaagaaccttaccaggccttgacatcctctgagcgcaatagagatattgctttcccttcggagacagagagacaggtggtgcatggttgtcgtcagctcgtgtcgtgagatgttgggttaagtcccgcaacgagcgcaacccctgtcattagttgccatcattgagttgggcactctaatgagactgccgtagacaatacggaggaaggtggggacgacgtcaaatcatcatgccccttatggcctgggctacacacgtgctacaatggtctgaacaaagggaagcgaaggagcgattcggagcgaatctcataaaacagatcccagttcggattgcaggctgcaactcgcctgcatgaagatggagttgctagtaatcgcggatcagaatgtcgcggtgaatgcgttcccgggtcttgtacacaccgcccgtcacaccacgagagtcggtaacacccgaagccagtgagacaaccggaaggagtcagctgtcgaaggtgggatcggtaattggggtg

SEQ ID NO: 1607 - DNA, 1610 bp, Psychrobacter arcticus
atgagccaagtttagtagcctctttaaagggttacatagcaagattaaactgaagagtttgatcatggctcagattgaacgctggcggcaggcttaacacatgcaagtcgagcggaaacgatggtagcttgctaccaggcgtcgagcggcggacgggtgagtaatacttaggaatctacctagtagtgggggatagcacggggaaactcgtattaataccgcatacgacctacgggagaaagggggcagtttactgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggaaaccctgatccagccatgccgcgtgtgtgaagaaggccttttggttgtaaagcactttaagcagtgaagaagactccatggttaatacccatggacgatgacattagctgcagaataagcaccggctaactctgtgccagcagccgcggtaatacagagggtgcaagcgttaatcggaattactgggcgtaaagggagcgtaggtggctcgataagtcagatgtgaaatccccgggctcaacctgggaactgcatctgatactgttgagctagagtatgtgagaggaaggtagaattccaggtgtagcggtgaaatgcgtagagatctggaggaataccgatggcgaaggcagccttctggcataatactgacactgaggctcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcgggttaagccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtggatagcttaaccttcgggaaggcgttcaccacggtgtggttgatgactggggtgaagtcgtaacaaggtagccgtaggggaacctgcggctggatcacctccttatagatggcattcggtcagcaagaat

SEQ ID NO: 1608 - DNA, 1428 bp, Psychrobacter cibarius
aagcttgcttctcgctgacgagcggcggacgggtgagtaatacttaggaatctacctagtagtgggggatagcacggggaaactcgtattaataccgcatacgacctacgggagaaagggggcagtttactgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggaaaccctgatccagccatgccgcgtgtgtgaagaaggccttttggttgtaaagcactttaagcagtgaagaagactccatggttaatacccatggacgatgacattagctgcagaataagcaccggctaactctgtgccagcagccgcggtaatacagagggtgcaagcgttaatcggaattactgggcgtaaagggagcgtaggtggctctataagtcagatgtgaaatccccgggcttaacctgggaactgcatctgaaactgtagagctagagtatgtgagaggaaggtagaattccaggtgtagcggtgaaatgcgtagagatctggaggaataccgatggcgaaggcagccttctggcataatactgacactgaggctcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcgggttaagccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtggatagcttaaccttcgggggagcgttcaccacggtgtggttgatgactggggtgaagtcgtaacaaggtagc

SEQ ID NO: 1609 - DNA, 1586 bp, Psychrobacter cryohalolentis
gatgagccaagtttagaagtctctttaaaggacttcatagcaagattaaactgaagagtttgatcatggctcagattgaacgctggcggcaggcttaacacatgcaagtcgagcggaaacgatgatagcttgctatcaggcgtcgagcggcggacgggtgagtaatacttaggaatctacctagtagtgggggatagcacggggaaactcgtattaataccgcatacgacctacgggagaaagggggcagtttactgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggaaaccctgatccagccatgccgcgtgtgtgaagaaggccttttggttgtaaagcactttaagcagtgaagaagactcttcggttaatacccggagacgatgacattagctgcagaataagcaccggctaactctgtgccagcagccgcggtaatacagagggtgcaagcgttaatcggaattactgggcgtaaagggagcgtaggtggctcgataagtcagatgtgaaatccccgggctcaacctgggaactgcatctgatactgttgagctagagtatgtgagaggaaggtagaattccaggtgtagcggtgaaatgcgtagagatctggaggaataccgatggcgaaggcagccttctggcataatactgacactgaggctcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcgggttaagccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtggatagcttaaccttcgggggagcgttcaccacggtgtggttgatgactggggtgaagtcgtaacaaggtagccgtaggggaacctgcggctggatcacctcctta

SEQ ID NO: 1610 - DNA, 1472 bp, Psychrobacter faecalis
ggctcagattgaacgctggcggcaggcttaacacatgcaagtcgagcggtaacaggagaagcttgcttctcgctgacgagcggcggacgggtgagtaatacttaggaatctacctagtagtgggggatagctcggggaaactcgaattaataccgcatacgacctacgggagaaagggggcaacttgttgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggcaaccctgatccagccatgccgcgtgtgtgaagaaggccttttggttgtaaagcactttaagcagtgaagaagactccatggttaatacccatggacgatgacattagctgcagaataagcaccggctaactctgtgccagcagccgcggtaatacagagggtgcaagcgttaatcggaattactgggcgtaaagcgagcgtaggtggcttgataagtcagatgtgaaagccccgggcttaacctgggaacggcatctgatactgttaggctagagtaggtgagaggaaggtagaattccaggtgtagcggtgaaatgcgtagagatctggaggaataccgatggcgaaggcagccttctggcatcatactgacactgaggttcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcggtttggccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtgggtagcctaaccttttaggatggcgctcaccacggtgtggttgatgactggggtgaagt

SEQ ID NO: 1611 - DNA, 1468 bp, Psychrobacter nivimaris
agattgaacgctggcggcaggcttaacacatgcaagtcgagcggaaacgatgatagcttgctatcaggcgtcgagcggcggacgggtgagtaatacttaggaatctacctagtagtgggggatagcacggggaaactcgtattaataccgcatacgacctacgggagaaagggggcagtttactgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggaaaccctgatccagccatgccgcgtgtgtgaagaaggccttttggttgtaaagcactttaagcagtgaagaagactcttcggttaatacccggagacgatgacattagctgcagaataagcaccggctaactctgtgccagcagccgcggtaatacagagggtgcaagcgttaatcggaattactgggcgtaaagcgagcgtaggtggcttgataagtcagatgtgaaatccccgggcttaacctgggaactgcatctgaaactgttaggctagagtaggtgagagggaggtagaatttcaggtgtagcggtgaaatgcgtagagatctgaaggaataccgatggcgaaggcagcctcctggcatcatactgacactgaggctcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcgggttaagccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtggatagcctaaccttcgggaaggcgttcaccacggtgtggttgatgactggggtgaagtc

SEQ ID NO: 1612 - DNA, 1468 bp, Psychrobacter pulmonis
agattgaacgctggcggcaggcttaacacatgcaagtcgagcggtaacaggagaagcttgcttctcgctgacgagcggcggacgggtgagtaatacttaggaatctacctagtagtgggggatagctcggggaaactcgaattaataccgcatacgacctacgggagaaagggggcaacttgttgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggcaaccctgatccagccatgccgcgtgtgtgaagaaggccttttggttgtaaagcactttaagcagtgaagaagactccatggttaatacccatggacgatgacattagctgcagaataagcaccggctaactctgtgccagcagccgcggtaatacagagggtgcaagcgttaatcggaattactgggcgtaaagcgagcgtaggtggcttgataagtcagatgtgaaagccccgggcttaacctgggaacggcatctgatactgttaggctagagtaggtgagaggaaggtagaattccaggtgtagcggtgaaatgcgtagagatctggaggaataccgatggcgaaggcagccttctggcatcatactgacactgaggttcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcggtttggccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtggttagcctaaccttttaggaaggcgatcaccacggtgtggttgatgactggggtgaagtc

SEQ ID NO: 1613 - DNA, 1457 bp, Psychrobacter sp.
  13983
attgaacgctggcggcaggcttaacacatgcaagtcgagcggtaacaggagaagcttgcttctygctgacgagcggcggacgggtgagtaatacttaggaatctgcccagtagtgggggatagcacggggaaactcgtattaataccgcatacaccctacggggaaaagggggcgcttgcgctctcgctattggatgagcctaagtcggattagctagttggtggggtaaaggcctaccaaggcgacgatctgtagctggtctgagaggatgatcagccacaccgggactgagacacggcccggactcctacgggaggcagcagtggggaatattggacaatgggggcaaccctgatccagccatgccgcgtgtgtgaagaaggccttttggttgtaaagcactttaagcagtgaagaagactctatggttaatacccatagacgatgacattagctgcagaataagcaccggctaactctgtgccagcagccgcggtaatacagagggtgcaagcgttaatcggaattactgggcgtaaagcgagcgtaggtggcttaataagtcagatgtgaaatccccgggcttaacctgggaactgcatctgatactgttgggctagagtaggtgagagggaggtagaatttcaggtgtagcggtgaaatgcgtagagatctgaaggaataccgatggcgaaggcagcctcctggcatcatactgacactgaggttcgaaagcgtgggtagcaaacaggattagataccctggtagtccacgccgtaaacgatgtctactagtcgttggggaacttgattccttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttttccttagttaccagcggtttggccggggactctaaggatactgccagtgacaaactggaggaaggcggggacgacgtcaagtcatcatggcccttacgaccagggctacacacgtgctacaatggtaggtacagagggctgctacacagcgatgtgatgcgaatctcaaaaagcctatcgtagtccagattggagtctgcaactcgactccatgaagtcggaatcgctagtaatcgcggatcagaatgccgcggtgaatacgttcccgggccttgtacacaccgcccgtcacaccatgggagttgattgcaccagaagtgggtagcctaacttttagagggcgctcaccacggtgtggtcgatgactggggtg

SEQ ID NO: 1614 - DNA, 1327 bp, Pyramidobacter piscolens
gacgaacgctggcggcgtgcttaacacatgcaagttgagcgagcagcggacgggtgagtaaagcacaaggacttgtccgaaagagagggacacctgcgggaaaccggagctaatacctcataaaaaaggcgcttttggagagacttgtgtcctatcaggcagttggtgaggtaacggctcaccaaaccgaagacgggtagccggactgagaggtcgaccggccacattggaactgagagacggtccagactcctacgggaggcagcagtggggaatattgggcaatgggcgcaagcctgacccagcgacgccgcgtgagggaagacagccttcgggttgtaaacctctgttgcaggggaagatgacggtaccctgcgaggaagctccggctaactacgtgccagcagccgcggtaatacgtagggagcgagcgttgtccggaattactgggcgtaaagggcgcgtaggcggcgcttcaagtcgtctgtcaaaagccgaggctcaacctcggtgcgcagacgaaactggagagcttgagaagcagagaggcaaacagaattcctggtgtagcggtgaaatgcgtagatatcaggaagaataccagtggcgaaggcggtttgctggctgcctgacgctgaagcgcgaaagccaggggagcaaacgggattagataccccggtagtcctggcagtaaacgatgtatgctgggtgtgggacgttccgtgccgaagttaacgcgataagcataccgcctggggagtacggtcgcaagattgaaactcaaaggaattgacgggggcccgcacaagcggtggagcacgtggtttaattcgatgcaaaccgaagaaccttacctggacttgacatcaacaggtgctgcatggctgtcgtcagctcgtgtcgtgagatgttgggttaagtcccgcaacgagcgcaacccctattgccggttgctaccagctgagcactccggcgagactgccatcgacaagatggaggaaggtggggacgacgtcaagtcatcatggcccatatgtccagggcgacacacatgctacaatggatggcagagagaagcgagcccgaaaggagaagcagatcccaaccatccccagttcggatgcagtctgcaactcgactgcagaagttggaatcgctagtaatcgcggatcagccaagccgcggtgaatacgttcccgggccttgtacacaccgcccgtcacaccatccgagtcgggtgctctcaaagccggagcctaaggatccgcctaaagagtgtccggtgaggagggtgaagtcgtaacaaggtaaccgtacgggaacgtgc

SEQ ID NO: 1615 - DNA, 1540 bp, Ralstonia pickettii
ttgaactgaagagtttgatcctggctcagattgaacgctggcggcatgccttacacatgcaagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcgattaccacggtagggttcatgactggggtgaagtcgtaacaaggtagccgtatcggaaggtgcggctggatcacctccttt

SEQ ID NO: 1616 - DNA, 1540 bp, Ralstonia sp.
  5_7_47FAA
ttgaactgaagagtttgatcctggctcagattgaacgctggcggcatgccttacacatgcaagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtgaggtaaaggctcaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcgattaccacggtagggttcatgactggggtgaagtcgtaacaaggtagccgtatcggaaggtgcggctggatcacctccttt

SEQ ID NO: 1617 - DNA, 1515 bp, Raoultella ornithinolytica
cagattgaacgctggcggcacgcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttagtgattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtavagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggctggatcacctcctt

SEQ ID NO: 1618 - DNA, 1398 bp, Raoultella planticola
tcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggggccttcgggaactctgagacagaggctgcatggctgtcgtcagctcgtgtgatgaaattttgggattagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcg

SEQ ID NO: 1619 - DNA, 1454 bp, Raoultella terrigena
tgaacgctggcggcaggcctaacacatgcaagtcgagcggtagcacagaagagcttgctcttcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttagcgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatga

SEQ ID NO: 1620 - DNA, 1432 bp, Rhodobacter sp.
  oral taxon C30
agagtttgatcctggctcagaacgaacgctggcggcaggcctaacacatgcaagtcgaacgagatcttcggatctagtggcggacgggtgagtaacgcgtgggaacgtgccctttggttcggaatagcctcgggaaactgggagtaataccggatacgcccttcgggggaaagatttatcgccaaaggatcggcccgcgttggattaggtagttggtggggtaacggcctaccaagccgacgatccatagctggtttgagaggatgatcagccacactgggactgagacacggcccagactcctacgggaggcagcagtggggaatcttagacaatgggggcaaccctgatctagccatgccgcgtgatcgatgaaggccttagggttgtaaagatctttcagctgggaagataatgactgtaccagcagaagaagccccggctaactccgtgccagcagccgcggtaatacggagggggctagcgttgttcggaattactgggcgtaaagcgcacgtaggcggaccagaaagtcagaggtgaaatcccagggctcaaccttggaactgcctttgaaactcctggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagccatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggcgatcgcggttccagagatggttccttcagttcggctggatcgcacacaggtgctgcatggctgtcgtcagctcgtgtcgtgagatgttcggttaagtccggcaacgagcgcaacccacactttcagttgccatcattcagttgggcactctgaaagaactgccggtgataagccggaggaaggtgtggatgacgtcaagtcctcatggcccttacgggttgggctacacacgtgctacaatggtggtgacaatgggttaatccccaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgacgacggtgcgccaacctcgcaagaggaagcagccggccacggtaggctcagtgactggggtgaagtcgtaacaaggtagccgta

SEQ ID NO: 1621 - DNA, 1466 bp, Rhodobacter sphaeroides
caacttgagagtttgatcctggctcagaatgaacgctggcggcaggcctaacacatgcaagtcgagcgaagtcttcggacttagcggcggacgggtgagtaacgcgtgggaacgtgccctttgcttcggaatagccccgggaaactgggagtaataccgaatgtgccctttgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgatcgatgaaggccttagggttgtaaagatctttcaggtgggaagataatgacggtaccaccagaagaagccccggctaactccgtgccagcagccgcggtaatacggagggggctagcgttattcggaattactgggcgtaaagcgcacgtaggcggatcggaaagtcagaggtgaaatcccagggctcaaccctggaactgcctttgaaactcccgatcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggcgatcgcggttccagagatggttccttcagttcggctggatcgcacacaggtgctgcatggctgtcgtcagctcgtgtcgtgagatgttcggttaagtccggcaacgagcgcaacccacgtccttagttgccagcattcagttgggcactctagggaaactgccggtgataagccggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggaattggttctacccgaaggcggtgcgccaacctcgcaagaggaggcagccgaccacggtaggatcagtgactggggtgaagtcgtaacaaggtagccgtaggggaacctgcggctggatcacctcctt

SEQ ID NO: 1622 - DNA, 1477 bp, Rhodococcus corynebacterioides
  modified_base (970)..(970): a, c, t, g, unknown or other
cctggctcaggacgaacgctggcggcgtgcttaacacatgcaagtcgaacggtaaggcccttcggggtacacgagtggcgaacgggtgagtaacacgtgggtgatctgccctgcacttcgggataagcccgggaaactgggtctaataccggataggactgcgcggtgcatgccgtgtggtggaaagatttatcggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggacgaagcgcaagtgacggtacctgcagaagaagcaccggccaactacgtgccagcagccgcggtaatacgtagggtgcaagcgttgtccggaattactgggcgtaaagagctcgtaggcggtttgtcgcgtcgtctgtgaaaaccagcagctcaactgttggcttgcaggcgatacgggcagacttgagtatttcaggggagactggaattcctggtgtagcggtgaaatgcgcagatatcaggaggaacaccggtggcgaaggcgggtctctgggaaataactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaagccgtngagatacggccccccttgtggtcggtgtacaggtggtgcatggctgtcgtcagctcgtgtcgtgagatgttgggttaagtcccgcaacgagcgcaacccttgtcctgtgttgccagcacgttatggcggggactcgcaggagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccgg

SEQ ID NO: 1623 - DNA, 1523 bp, Rhodococcus equi
cttcaacggagagtttgatcctggctcaggacgaacgctggcggcgtgcttaacacatgcaagtcgaacggtaaggccccttcgggggtacacgagtggcgaacgggtgagtaacacgtgggtgatctgccctgcactctgggataagcctgggaaactgggtctaataccggatatgagctcctgtcgcatggcgggggttggaaaggtttactggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgagagtgacggtacctgcagaagaagcaccggccaactacgtgccagcagccgcggtaatacgtagggtgcgagcgttgtccggaattactgggcgtaaagagctcgtaggcggtttgtcgcgtcgtccgtgaaaacttggggctcaaccccaagcttgcgggcgatacgggcagacttgagtactgcaggggagactggaattcctggtgtagcggtgaaatgcgcagatatcaggaggaacaccggtggcgaaggcgggtctctgggcagtaactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagccgtagagatacggccccccttgtggtcggtatacaggtggtgcatggctgtcgtcagctcgtgtcgtgagatgttgggttaagtcccgcaacgagcgcaacccttgtcctgtgttgccagcgcgtaatggcggggactcgcaggagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttct

SEQ ID NO: 1624 - DNA, 1527 bp, Rhodococcus erythropolis
acggagagtttgatcctggctcaggacgaacgctggcggcgtgcttaacacatgcaagtcgagcggtaaggcctttcggggtacacgagcggcgaacgggtgagtaacacgtgggtgatctgccctgcacttcgggataagcctgggaaactgggtctaataccggatatgacctcaggttgcatgacttgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtcgaaggtgggatcggcgattgggacgaagtcgtaacaaggtagccgtaccggaaggtgcggctggatcacctcctttctaaggagca

SEQ ID NO: 1625 - DNA, 1424 bp, Rhodococcus fascians
cctggctcaggacgaacgctggcggcgtgcttaacacatgcaagtcgagcggtaaggcctttcggggtacacgagcggcgaacgggtgagtaacacgtgggtgatctgccctgcactctgggataagcttgggaaactgggtctaataccggatatgaccacagcatgcatgtgttgtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcggaagcctgatgcagcgacgccgcgtgagggatgaaggccttcgggttgtaaacctctttcagcagggacgaagcgtgagtgacggtacctgcagaagaagcaccggctaactacgtgccagcagccgcggtaatacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatcaggaggaacaccggtggcgaaggcgggtctctgggaaacaactgacgctgaggaacgaaagcgtgggtagcaaacaggattagataccctggtagtccacgccgtaaacggtgggcgctaggtgtgggttccttccacgggatctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaaaccgtagagatacggtcccccttgtggtcggtgtacaggtggtgcatggctgtcgtcagctcgtgtcgtgagatgttgggttaagtcccgcaacgagcgcaacccttgtcttatgttgccagcacgtaatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttacggggagggagccg

SEQ ID NO: 1626 - DNA, 1489 bp, Rhodopseudomonas palustris
tccaacttgagagtttgatcctggctcagagcgaacgctggcggcaggcttaacacatgcaagtcgaacgggcatagcaatatgtcagtggcagacgggtgagtaacgcgtgggaacataccttttggttcggaacaactgagggaaacttcagctaataccggataagccctaacggggaaagatttatcgccgaaagattggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtttttaagtcagaggtgaaatcctggagctcaactccagaactgcctttgatactgaaagtcttgagtacgggagaggtgagtggaactgcgagtgtagaggtgaaattcgtagatattcgcaagaacaccagtggcgaaggcggctcactggcccgttactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtctaggaccggtcgcagagatgtgaccttctcttcggagcctagagcacaggtgctgcatggctgtcgtcagctcgtgtcgtgagatgttgggttaagtcccgcaacgagcgcaacccccgtctttagttgctaccatttagttgagcactctaaagagactgccggtgataagccgcgaggaaggtggggatgacgtcaagtcctcatggcccttacgggctgggctacacacgtgctacaatggcggtgacaatgggatgctaaagggcaacctctcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggttttacctgaaggtagtgcgctaacccgcaagggaggcagctaaccacggtagggtcagcgactggggtgaagtcgtaacaaggtagccgtaggggaacctgcggctggatcacctcct

SEQ ID NO: 1627 - DNA, 1508 bp, Rickettsia akari
gacagaatcaaacttgagagtttgatcctggctcagaacgaacgctatcggtatgcttaacacatgcaagtcggacggactgattggggttttctccagttagtgagtggcgaacgggtgagtaacacgtgggaatctgcccatcagtacggaataacttttagaaataaaagctaataccgtatattctctacggaggaaagatttatcgctgatggatgagcccgcgtcggattaggtagttggtgaggtaacggctcaccaagccgacgatctgtagttggtctgagaggatgatcagccacactgggactgagacacggcccagactcctacgggaggcagcagtggggaatattggacaatgggcgaaagcctgatccagcaataccgagtgagtgatgaaggccctagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacgactgacgctgatgcacgaaagcgtggggagcaaacaggattagataccctggtagtccacgccgtaaacgatgagtgctagatatcggaagagtctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacctttgacatggtggttgcggatcgcagagatgctttccttcagttcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttatgggttgggctacacgcgtgctacaatggtgtttacagagggaagcaagacggtaacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtagaattagcgactggggtgaagtcgtaacaaggtagccgtaggggaacctgcggctggattacctcctta

SEQ ID NO: 1628 - DNA, 1501 bp, Rickettsia conorii
tcaaacttgagagtttgatcctggctcagaacgaacgctatcggtatgcttaacacatgcaagtcgaacggactaattggggcttgctccagttagttagtggcagacgggtgagtaacacgtgggaatctacccattagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaacaaggtagccgtaggggaacctgcggctggattacctcctta

SEQ ID NO: 1629 - DNA, 1501 bp, Rickettsia prowazekii
tcaaacttgagagtttgatcctggctcagaacgaacgctatcggtatgcttaacacatgcaagtcgaacggattaactagagctcgctttagttaattagtggcagacgggtgagtaacacgtgggaatctacccatcagtacggaataacttttagaaataaaagctaataccgtatattctctacggaggaaagatttatcgctgatggatgggcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaggattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggttacggattgcagagatgctttccttcagttcggctgggccacacacaggtgttgcatggctgtcgtcagctcgtgtcgtgagatgttgggttaagtcccgcaacgagcgcaacccttattcttatttgccagtgggtaatgccgggaactataagaaaactgccggtgataagccggaggaaggtggggacgacgtcaagtcatcatggcccttacgggttgggctacacgcgtgctacaatggtgtttacagagggaagcaatacggtgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctcctta

SEQ ID NO: 1630 - DNA, 1501 bp, Rickettsia rickettsii
tcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctaccactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggttgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaacaaggtagccgtaggggaacctgcggctggattacctcctta

SEQ ID NO: 1631 - DNA, 1432 bp, Rickettsia slovaca
agaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagattctctttcggtttcgtagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaa

SEQ ID NO: 1632 - DNA, 1501 bp, Rickettsia typhi
tcaaacttgagagtttgatcctggctcagaacgaacgctatcggtatgcttaacacatgcaagtcgaacggattaattagagcttgctctagttaattagtggcagacgggtgagtaacacgtgggaatctacccatcagtacggaataacttttagaaataaaagctaataccgtatattctctacggaggaaagatttatcgctgatggatgggcccgcgtcagattaggtagttggtgtggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggtggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaggattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggttatggattgcagagatgctttccttcagttcggctgggccacacacaggtgttgcatggctgtcgtcagctcgtgtcgtgagatgttgggttaagtcccgcaacgagcgcaacccttattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggtgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctcctta

SEQ ID NO: 1633 - DNA, 1526 bp, Robinsoniella peoriensis
gagagtttgattctggctcaggatgaacgctggcggcgtgcttaacacatgcaagtcgagcgaagcattaaaacagatttcttcggaawgaagttttratgactgagcggcggacgggtgagtaacgcgtgggtgaccygcctcatacagggggataacagacagaaatgtctgctaataccgcataagcgcacagtgctgcatggcacagtgtgaaaaactccggtggtatgagatggacccgcgtctgattagctagttggtaaggtaacggcttaccaaggcgacgatcagtagccggcctgagagggtgaacggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcatggcaagtctggtgtgaaaggcaggggctcaacccctggactgcattggaaactgtcaggctggagtgcaggagaggtaagtggaattcctagtgtagcggtgaaatgcgtagatattaggaggaacaccagtggcgaaggcgacttactggactgtaactgacgttgaggctcgaaagcgtggggagcaaacaggattagataccctggtagtccacgccgtaaacgatgaatactaggtgtcagggagcaaagctctttggtgccgcagctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggacagtaacgtgtcctttccttcgggacaagagtgacaggtggtgcatggttgtcgtcagctcgtgtcgtgagatgttgggttaagtcccgcaacgagcgcaacccttatcttcagtagccagcaattcggttgggcactctggagagactgccagggataacctggaggaaggtggggatgacgtcaaatcatcatgccccttatgatttgggctacacacgtgctacaatggcgtaaacaaagggaagcagccctgtgaaggtgagcaaatcccaaaaataacgtctcagttcggattgtagtctgcaactcgactacatgaagctggaatcgctagtaatcgcgaatcagaatgtcgcggatsaatacgttcccgggtcttgtacacaccgcccgtcacaccatgggagtcggaaatgcccgaagtcagtgacccaaccgtaaggagggagctgccgaaggtggagccggtaactggggtgaagtcgtaacaaggtagccgtatcggaaggtgcggctggatcacctccttc

SEQ ID NO: 1634 - DNA, 1371 bp, Roseburia cecicola
ggatgaacgctggcggcgtgcttaacacatgcaagtcgaacgaagcactctatttgattttcttcggaaatgaagattttgtgactgagtggcggacgggtgagtaacgcgtgggtaacctgctcatacagggggataacagttggaaacgactgctaataccgcataagcgcacagtactgcatggtaccgtgtgaaaaactccggtggtatgagatggacccgcgtctgattagccagttggcggggtacggcccaccaaagcgacgatcagtagccgacctgagagggtgaccggccacattgggactgagacacggcccaaactcctacgggaggcagcagtggggaatattgcacaatgggggaaaccctgagcagcgacgccgcgtgagcgaagaagtatttcggtatgtaaagctctatcagcagggaagaaaaaatgacggtacctgactaagaagcaccggctaaatacgtgccagcagccgcggtaatacgtatgtgcaagcgttatccggatttactgggtgtaaagggagcgcaggcggtgcggcaagtctgatgtgaaagcccggggctcaaccccggtactgcattggaaactgtcgtactagagtgtcggaggggtagtggaattcctagtgtagcggtgaaatgcgtagatattaggaggaacaccagtggcgaaggcggcttactggacgattactgacgctgaggctcgaaagcgtggggagcaaacaggattagatacctggtagtccacgccgtaaacgatgaatactaggtgtcggggagcattgctcttcggtgccgcagcaaacgcaataagtattccacctggggagtacgttcgcaagaatgaaactcaaaggaattgacgggacccgcacaagcggtggagcatgtggtttaattcgaagcaacgcgaagaaccttaccaagtcttgacatccttctgacaatgtatgtaatgtatattctcttcggagcagaagtgacaggtggtcatggttgtcgtcagctcgtgtcgtgagatgttgggttaagtcccgcaacgagcgcaacccttattcttagtagccagcggttcgagactgccagggataacctggaggaaggtggggatgacgtcaatcatcatgccccttatgacctacaatggcgtaaacaaagggaagcaagaccgtgaggtggagcaaatcccaaaaataacgtctctgcaactcgactacacgaagctggaatcgctagtaatcgcgatcagaatgtcgcggtgaataacacaccgcccgtcacaccatgggagttggtaatgcccgaagtcagtgacccaaccgcaaggagaggatcgataactggggtgaa

SEQ ID NO: 1635 - DNA, 1361 bp, Roseburia faecalis
tatttgattttcttcggaaatgaagattttgtgactgagtggcggacgggtgagtaacgcgtgggtaacctgcctcatacagggggataacagttggaaacgactgctaataccgcataagcgcacaggatcgcatgatctggtgtgaaaaactccggtggtatgagatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcgaggggtaagtggaattcctagtgtacggtgaaatgcgtagatattaggaggaacaccagtggcgaagcggcttactggacgataactgacgctgaggctcgaaagcgtggggagcaaacaggattagataccctggtagtccacgccgtaaacgatgaatactagtgtcggggagcattgctcttcggtgccgcacaaacgcaataagtattccacctggggagtacgttcgcaagaatgaaactcaaggaattgacggggacccgcacaagcggtggagcatgtgggttaattcgaagcaacgcgaagaaccttaccaagtcttgacatcccgatgacaaagtatgtaatgtactttctcttcggagcatcggtgacaggtggtgcatggttgtcgtcagctcgtgtcgtgagatgttgggttaagtcccgcaacgagcgcaacccctgttcttagtagccagcggttcggccgggcactctagggagactgccagggataacctggaggaaggcggggatgacgtcaaatcatcatgccccttatgacttgggctacacacgtgctacaatggcgtaaacaaagggaagcggagccgtgaggccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgc

SEQ ID NO: 1636 - DNA, 1297 bp, Roseburia faecis
gatgaacgctggcggcgtgcttaacacatgcaagtcgaacgagtggcggacgggtgagtaacgcgtgggtaacctgcctcatacagggggataacagttggaaacgactgctaataccgcataagaaaaagtggtatgagatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgaactgacgctgaggctcgaaagcgtggggagcaaacaggattagataccctggtagtccacgccgtaaacgatgaatactaggtgtcggggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccctgtccttagtagccagcggccgggcactctagggagactgccagggataacctggaggaaggcggggatgacgtcaaatcatcatgccccttatgacttgggctacacacgtgctacaatggcgtacaaagggaagcggagccgtgaggccgagcaaatctcaaaacgtctcagttcggatgtagtctgcaacccgactacagaagctggaatcgctagtaatcgcagatcagaatgctgcggtgaatacgttcccgggtcttgtacacaccgcccgtcacaccatgggagttggaaatgcccgaagtcagtacccagggagctgccgaaggcaggttcgataactggggtg

SEQ ID NO: 1637 - DNA, 1376 bp, Roseburia hominis
  modified_base (14)..(14): a, c, t, g, unknown or other
  modified_base (45)..(47): a, c, t, g, unknown or other
acgaagcactttanttgatttcttcggaatgaagtttttgtgacnnnagtggcggacgggtgagtaacgcgtgggtaacctgcctcatacagggggataacagttggaaacgactgctaataccgcataagcgcacaggattgcatgatccagtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgacagagtatgtaatgtactttctcttcggaacagtggtgacagatggtgcatgggggtcgtcagctcgtgtcgtgagatgttgggttaagtcccgcaacgagcgcaacccctattcttagtagccagcggtttggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccg

SEQ ID NO: 1638 - DNA, 1390 bp, Roseburia intestinalis
tcgaacgaagcactttatttgatttcttcggaatgaagattttgtgactgagtggcggacgggtgagtaacgcgtgggtaacctgcctcatacagggggataacagttggaaacgactgctaataccgcataagcgcacagggtcgcatgacctggtgtgaaaaactccggtggtatgagatggacccgcgtctgattagccagttggtggggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggcaaatactgccagcagccgcggtaatacgtatggtgcaagcgttatccggatttactgggtgtaaagggagcgcaggcggtacggcaagtctgatgtgaaagcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgagctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggaccatgtggtttaattcgaagcaacgcgaagaaccttaccaagtcttgacatcccgatgacagaacatgtaatgtgttttctcttcgaagcatcggtgacagagggtcggaggggtaagtgagctcgtgtcgtgagatgttgggttaagtcccgcaacgagcgcaacccctattcttagtagccagcggttaagccgggcactctagggagactgccagggataacctggaggaaggtggggatgacgtcaaatcatcatgccccttatgacttgggctacacacgtgctacaatggcgtaaacaaagggaagcgagcctgcgagggggagcaaatctcaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagct

SEQ ID NO: 1639 - DNA, 1374 bp, Roseburia inulinivorans
  modified_base (19)..(19): a, c, t, g, unknown or other
  modified_base (51)..(51): a, c, t, g, unknown or other
  modified_base (951)..(951): a, c, t, g, unknown or other
gaacgaagcacttttacangatttcttcggaatgaagttttagtgactgantggcggacgggtgagtaacgcgtgggtaacctgcctcacacagggggataacagttggaaacggctgctaataccgcataagcgcacagtaccgcatggtacagtgtgaaaaactccggtggtgtgagatggacccgcgtctgattagctagttggcagggcaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaaaagaaatgacggtacctgctaaacaccggctaaatacgtgccagcagccgcggtaatacgtatggtgcaagcgttatccggatttactgggtgtaaagggagcgcaggcggaaggctaagtctgatgtgaaagcccggggctcaaccccggtactgcattggaaactggtcatctagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggaaagcacagcttttcggtgccgccgcaaacgcattaagtattccacctggggagtacgttcgcaagaatgaaactcaaaggaattgacggggacccgcacaagcggtggagcatgtggtttaattggtataaagggagagcagcctgacgactaattctgatcttaaagcccggggctaatctgtggtttncttcgggacagaagtgacaggtggtgcatggttgtcgtcagctcgtgtcgtgagatgttgggttaagtcccgcaacgagcgcaacccttatccccagtagccagcggttcggccgggcactctgaggagactgccagggataacctggaggaaggtggggatgacgtcaaatcatcatgccccttatgacttgggctacacacgtgctacaatggcgtaaacaaagggaagcgagaccgtgaggtggagcaaatcccaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccg

SEQ ID NO: 1640 - DNA, 1235 bp, Roseburia sp.
  11SE37
tggcggcgtgcttaacacatgcaagtcgaacgagtggcggacgggtgagtaacgcgtgggtaacctgcctcatacagggggataacagttggaaacgactgctaataccgcataagaaaaagtggtatgagatggacccgcgtctgattagccagttggcagggtaacggcctaccaaagcgacgatcagtagccaacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgaactgacgctgaggctcgaaagcgtggggagcaaacaggattagataccctggtagtccacgccgtaaacgatgaatactaggtgtcggggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccctgttcttagtagccagcggccgggcactctagggagactgccagggataacctggaggaaggcggggatgacgtcaaatcatcatgccccttatgacttgggctacacacgtgctacaatggcgtacaaagggaagcaaagccgtgaggccgagcaaatctcaaaacgtctcagttcggatgtagtctgcaacccgactacagaagctggaatcgctagtaatcgcagatcagaatgctgcggtgaatacgttcccgggtcttgtacacaccgcccgtcacaccatgggagttggaaat

SEQ ID NO: 1641 - DNA, 1231 bp, Roseburia sp.
  11SE38
tggcggcgtgcttaacacatgcaagtcgaacgagtggcggacgggtgagtaacgcgtgggtaacctgcctcatacagggggataacagttggaaacgactgctaataccgcataagaaaaagtggtatgagatggacccgcgtctgattagccagttggcagggtaacggcctaccaaagcgacgatcagtagccaacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgaactgacgctgaggctcgaaagcgtggggagcaaacaggattagataccctggtagtccacgccgtaaacgatgaatactaggtgtcggggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccctgttcttagtagccagcggccgggcactctagggagactgccagggataacctggaggaaggcggggatgacgtcaaatcatcatgccccttatgacttgggctacacacgtgctacaatggcgtacaaagggaagcaaagccgtgaggccgagcaaatctcaaaacgtctcagttcggatgtagtctgcaacccgactacagaagctggaatcgctagtaatcgcagatcagaatgctgcggtgaatacgttcccgggtcttgtacacaccgcccgtcacaccatgggagttgg

SEQ ID NO: 1642 - DNA, 1469 bp, Roseiflexus castenholzii
agagtttgatcctggctcaggacgaacgctggcggcgtgcctaatgcatgcaagtcgaacgcacgcgcttcggcgcgtgagtggcgcacggctgagtaacacgtgggaacccgccctccggtgggggataacgagacgaaagtcgcgctaatcccgcatacgtccgcaaggggaaagcgcttcggcgcgccggaggaggggcctgcggcccatcaggtggttggtggggtaacggcctaccaagccgatgacgggtagctggtctgggaggatgaccagccagactgggactgagacacggcccagactcctacgggaggcagcagcaaggaattttcggcaatgggcgcaagcctgaccgagcaacgccgcgtgcgggatgacggccttcgggttgtaaaccgcttttcggggggacgactacgacggtacccccggaagaagccccggctaactctgtgccagcagccgcggtaagacagagggggcgagcgttgtccggagttactgggcgtaaagcgcgcgcaggcggtggtctcagtgtcgtgtgaaagcccccggctcaaccgggggaggtcatggcaaactagacgactagagcggcggagaggcccctcgaattgccggtgtagcggtgaaatgcgtagagatcggcaggaagaccaagggggaagccagggggctggccgctggctgacgctgaggcgcgacagcgtggggagcaaaccggattagatacccgggtagtccacgccgtaaacgatgaccactcggcgtgtggcgactattgacgtcgcggcgcgcctaagcttacgcgtgaagtggtccgcctgggaactacgagcgcaagcttaaaactcaaaggaattgacgggggcccgcacaagcagcggagcgtgtggtttaattcgaggcaacccgaagaaccttacccaggctggacatgacggtgcaggcggcggaaacgtcgcggccttcgagggaccgtcacaggtgctgcatggctgtcgtcagctcgtgtcgtgagatgttgggttaagtcccgcaacgagcgcaacccctgcggttagttaccggtgtctaaccggactgcccttcggggaggaaggcggggatgacgtcaagtccgcatggccctgacgcctggggcgacacacacgctacaatggcgccgacaatgcgtggcgaccgcgcgagcggaggcaaatcgccaaacggcgtctcagtgcagatcgggggctgcaactcgcccccgtgaaggcggagttgctagtaaccgcgtatcagccatggcgcggtgaatacgtacccgggccttgtacacaccgcccgtcacgtcatgggagttgtcaatgcctgaagtccgtgcgctaaccgtcaggaggcagcggccgagggcaggggcagcgactgggacgaagtcgtaacaaggtagccgtaccggaaggtgcggctggatcacctccttt

SEQ ID NO: 1643 - DNA, 1312 bp, Roseomonas cervicalis
aagcagcgatgcgcctttggagtaacctgcgtccgattagctagttggtggggtaaaggcctaccaaggcgacgatcggtagctggtctgagaggacgaccagccacactgggactgagacacggcccagactcctacgggaggcagcagtggggaatattggacaatgggcgcaagcctgatccagcaatgccgcgtgggtgaagaaggtcttcggatcgtaaagccctttcggcggggacgatgatgacggtacccgcagaagaagccccggctaacttcgtgccagcagccgcggtaatacgaagggggctagcgttactcggaattactgggcgtaaagggcgcgtaggcggcgctccaagttaggcgtgaaagccctgggctcaacctggggactgcgcttaagactggagtgctagaggatggaagagggttgtggaattcccagtgtagaggtgaaattcgtagatattgggaagaacaccggtggcgaaggcggcaacctggtccatttctgacgctgaggcgcgatagcgtggggagcaaacaggattagataccctggtagtccacgccgtaaacgatgtgcgctgaatgttggggttcctagaacctcagtgttgtagctaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatggccacgaccggttcagagatgaacttttcccgcaagggacgtggtgcacaggtgctgcatggctgtcgtcagctcgtgtcgtgagatgttgggttaagtcccgcaacgagcgcaaccctcgcctttagttgccagcacgtttgggtgggcactctagaggaactgccggtgacaagccggaggaaggtggggatgacgtcaagtcctcatggcccttatgggctgggctacacacgtgctacaatggcggtgacaatgggaagccaggcagcgatgtcgagccgatcccaaaaagccgtctcagttcagatcgcagcctgcaactcggctgcgtgaaggtggaatcgctagtaatcgcggatcagcacgccgcggtgaatacgttcccgggccttgtacacaccgcccgtcacaccatgggagttggttctaccttaagcaggtgcggtaaccgcaaggagctagcctgccacggtagggtcagtgactggggtgaagtcgtaacaaggtagccgtaggggaacctgcggctggatcacctccttt

SEQ ID NO: 1644 - DNA, 1482 bp, Roseomonas mucosa
ttagtttgatcctggctcagagcgaacgctggcggcatgcttaacacatgcaagtcgcacgggcagcaatgtcagtggcggacgggtgagtaacgcgtaggaacgtgtcctgaggtgggggacaaccccgggaaactggggctaataccgcatatgggctgaggcccaaagccgagaggcgcctttggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattcgtagatattgggaagaacaccggtggcgaaggcggcgagctggtccattactgacgctgaggcgcgacagcgtggggagcaaacaggattagataccctggtagtccacgccgtaaacgatgtgcgctggatgttggggcccatagggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatggtcacgaccggtccagagatggactttcctagcaataggcgtgatgcacaggtgctgcatggctgtcgtcagctcgtgtcgtgagatgttgggttaagtcccgcaacgagcgcaaccctcgcctctagttgccagcatgttcgggtgggcactctagaggaactgccggtgacaagccggaggaaggtggggatgacgtcaagtcctcatggcccttatgggctgggctacacacgtgctacaatggcggtgacagagggaagccaggtcgcgaggccgagccgatcccgaaaagccgtctcagttcggattgcactctgcaactcgggtgcatgaaggtggaatcgctagtaatcgcggatcagcacgccgcggtgaatacgttcccgggccttgtacacaccgcccgtcacaccatgggagttggttctaccttaagtcgttgcgctaaccagcgatgggggcaggcgaccacggtagggtcagcgactggggtgaagtcgtaacaaggtagccgtaggggaacctgcggttggatcacctcctaa

SEQ ID NO: 1645 - DNA, 1295 bp, Roseomonas sp.
  NML94-0193
acgctggcggcatgcttaacacatgcaagtcgcacgagtggcggacgggtgagtaacgcgtaggaacgtgtccagaggtgggggacaaccccgggaaactggggctaataccgcatgggcaaaggcgccattggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattcgtagatattgggaagaacaccggtggcgaaggcggcgagctggtccaactgacgctgaggcgcgacagcgtggggagcaaacaggattagataccctggtagtccacgccgtaaacgatgtgcgctggatgttggggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatgcacaggtgctgcatggctgtcgtcagctcgtgtcgtgagatgttgggttaagtcccgcaacgagcgcaaccctcgcctctagttgccagcatgtgggcactctagaggaactgccggtgacaagccggaggaaggtggggatgacgtcaagtcctcatggcccttatgggctgggctacacacgtgctacaatggcggtcagagggaagccaggtcgcgaggccgagccgatcccggccgtctcagttcggatgcactctgcaactcgggtgcagaaggtggaatcgctagtaatcgcggatcagcacgccgcggtgaatacgttcccgggccttgtacacaccgcccgtcacaccatgggagttggttctaccttaagtcgttcgctaggcaggcgaccacggtagggtcagcgactggggtgaagtc

SEQ ID NO: 1646 - DNA, 1319 bp, Roseomonas sp.
  NML97-0121
agcgaacgctggcggcatgcttaacacatgcaagtcgcacgagtggcggacgggtgagtaacgcgtaggaacgtgtccagaggtgggggacaaccccgggaaactggggctaataccgcatatgcaaaggcgcctttggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattcgtagatattgggaagaacaccggtggcgaaggcggcgagctggtccaactgacgctgaggcgcgacagcgtggggagcaaacaggattagataccctggtagtccacgccgtaaacgatgtgcgctggatgttggggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatgcacaggtgctgcatggctgtcgtcagctcgtgtcgtgagatgttgggttaagtcccgcaacgagcgcaaccctcgcctctagttgccagcatgtgggcactctagaggaactgccggtgacaagccggaggaaggtggggatgacgtcaagtcctcatggcccttatgggctgggctacacacgtgctacaatggcggtcagagggaagccaggtcgcgaggccgagccgatcccggccgtctcagttcggatgcactctgcaactcgggtgcagaaggtggaatcgctagtaatcgcggatcagcacgccgcggtgaatacgttcccgggccttgtacacaccgcccgtcacaccatgggagttggttctaccttaagtcgttcgctaggcaggcgaccacggtagggtcagcgactggggtgaagtcgtaacaaggtagccgtagg

SEQ ID NO: 1647 - DNA, 1314 bp, Roseomonas sp.
  NML98-0009
acgctggcggcatgcttaacacatgcaagtcgcacgagtggcggacgggtgagtaacgcgtaggaacgtgtccagaggtgggggacaaccccgggaaactggggctaataccgcatatgcaaaggcgcctttggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattcgtagatattgggaagaacaccggtggcgaaggcggcgagctggtccaactgacgctgaggcgcgacagcgtggggagcaaacaggattagataccctggtagtccacgccgtaaacgatgtgcgctggatgttggggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatgcacaggtgctgcatggctgtcgtcagctcgtgtcgtgagatgttgggttaagtcccgcaacgagcgcaaccctcgcctctagttgccagcatgtgggcactctagaggaactgccggtgacaagccggaggaaggtggggatgacgtcaagtcctcatggcccttatgggctgggctacacacgtgctacaatggcggtcagagggaagccaggtcgcgaggccgagccgatcccggccgtctcagttcggatgcactctgcaactcgggtgcagaaggtggaatcgctagtaatcgcggatcagcacgccgcggtgaatacgttcccgggccttgtacacaccgcccgtcacaccatgggagttggttctaccttaagtcgttcgctaggcaggcgaccacggtagggtcagcgactggggtgaagtcgtaacaaggtagccgtagg

SEQ ID NO: 1648 - DNA, 1297 bp, Roseomonas sp.
  NML98-0157
agcgaacgctggcggcatgcttaacacatgcaagtcgcacgagtggcggacgggtgagtaacgcgtaggaacgtgtcctgaggtgggggacaaccccgggaaactggggctaataccgcatatgcaaaggcgcctttggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattsgtagatattgggaagaacaccggtggygaaggcggcgagctggtccaactgacgctgaggcgcgacagcgtggggagcaaacaggattagataccctggtagtccacgccgtaaacgatgtgcgctggatgttggggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatgcacaggtgctgcatggctgtcgtcagctcgtgtcgtgagatgttgggttaagtcccgcaacgagcgcaaccctcgcctctagttgccagcatgtgggcactctagaggaactgccggtgacaagccggaggaaggtggggatgacgtcaagtcctcatggcccttatgggctgggctacacacgtgctacdatggcggtcagagggaagccaggtcgcgaggccgagccgatcccggccgtctcagttcggatgcactctgcaactcgggtgcagaaggtggaatcgctagtaatcgcggatcagcacgccgcggtgaatacgttcccgggccttgtacacaccgcccgtcacaccatgggagttggttctaccttaagtcgttcgctaggcaggcgaccacggtagggtcagcgactggggtgaa

SEQ ID NO: 1649 - DNA, 1269 bp, Rothia aeria
  modified_base (838)..(838): a, c, t, g, unknown or other
  modified_base (1115)..(1115): a, c, t, g, unknown or other
  modified_base (1200)..(1200): a, c, t, g, unknown or other
ccgtggattagtggcgaacgggtgagtaatacgtgagtgacctacctttgactctgggataagcctgggaaactgggtctaataccggatacgaccaatctctgcatggggtgttggtggaaagcgttatggagtggttttagatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcatcgaagaagcgaaagtgacggtaggtgcagagaaagcgccggctaactacgtgccagcagccgcggtaatacgtagggcgcgagcgttgtccggaattattgggcgtaaagagcttgtaggcggttggtcgcgtctgctgtgaaaggccggggcttaactccggttttgcagtgggtacgggctaactagagtgcagtaggggagactggaattcctggtgtagcggtggaatgcacagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcactatnggcggagcatgcggattaattcgatgcaacgcgaagaaccttaccaaggcttgacatgcattagatcgcgtcagagatggcgtttcccttcggggctggtgtacaggtggtgcatggttgtcgtcagctcgtgtcgtgagatgttgggttaagtcccgcaacgagcgcaaccctcgttctatgttgccagcggttcggccggggactcataggagactgccggggttaactcggaggaaggtggggatgacgtcaaatcatcatgccccttatgttntgggcttcacgcatgctacaatggccggtacagagggttgcgatactgtgaggtggagctaatcccttaaagccggtctcagttnggattggggtatgcaactcgaccccatgaagtcggagtcgctagtaatcgcagatcagcaacgctgcgg

SEQ ID NO: 1650 - DNA, 1531 bp, Rothia dentocariosa
ttgtaacggagagtttgattctggctcaggacgaacgctggcggcgtgcttaacacatgcaagtcgaacgatgaagcctagcttgctaggtggattagtggcgaacgggtgagtaatacgtgagtgacctacctttgactctgggataagcctgggaaactgggtctaataccggatacgaccaatctccgcatggggtgttggtggaaagcgttatggagtggttttagatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcatcgaagaagcgaaagtgacggtaggtgcagagaaagcgccggctaactacgtgccagcagccgcggtaatacgtagggcgcgagcgttgtccggaattattgggcgtaaagagcttgtaggcggttggtcgcgtctgctgtgaaaggctggggcttaaccctggttttgcagtgggtacgggctaactagagtgcagtaggggagactggaattcctggtgtagcggtggaatgcgcagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatatactggactgcgtcagagatggcgtttcccttcggggctggtatacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacagagggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccctggtggggggagccgtcgaaggtgggactggcgattgggactaagtcgtaacaaggtagccgtaccggaaggtgcggctggatcacctcctttct

SEQ ID NO: 1651 - DNA, 1535 bp, Rothia mucilaginosa
tttcaacggagagtttgattctggctcaggacgaacgctggcggcgtgcttaacacatgcaagtcgaacgatgaagcctagcttgctaggtggattagtggcgaacgggtgagtaatacgtgagtaacctacctttaactctgggataagcctgggaaactgggtctaataccggatacgaccaatctccgcatggggtgttggtggaaagcgttatgtagtggttatagatgggctcacggcctatcagcttgttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcagggaagaagagaaattgacggtacctgcagagaaagcgccggctaactacgtgccagcagccgcggtaatacgtagggcgcgagcgttgtccggaattattgggcgtaaagagcttgtaggcggtttgtcgcgtctgctgtgaaaggccggagcttaactccgtgtattgcagtgggtacgggcagactagagtgcagtaggggagactggaactcctggtgtagcggtggaatgcgcagatatcaggaagaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatatactggaccgcatcagagatggtgtttcccttcggggctggtatacaggtggtgcatggttgtcgtcagctcgtgtcgtgagatgttgggttaagtcccgcaacgagcgcaaccctcgttctatgttgccagcacgtaatggtggggactcataggagactgccggggtcaactcggaggaaggtggggatgacgtcaaatcatcatgccccttatgtcttgggcttcacgcatgctacaatggccggtacagagggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccaaagccggtggcctaaccttttggagggagccgtctaaggtgggattggcgattgggactaagtcgtaacaaggtagccgtaccggaaggtgcggctggatcacctcctttctaagg

SEQ ID NO: 1652 - DNA, 1481 bp, Rothia nasimurium
gacgaacgctggcggcgtgcttaacacatgcaagtcgaacgatgaagcccagcttgctgggtggattagtggcgaacgggtgagtaatacgtgagtaacctgcctttaactctgggataagccttggaaacgaggtctaataccggatacgaccagttcccgcatgggatgctggtggaaagggatatgtactggttttagatgggctcacggcctatcagcttgttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagcttgtaggcggtttgtcgcgtctgctgtgaaagcccggggcttaaccccgggtttgcagtgggtacgggctaactagagtgcagtaggggagactggaattcctggtgtagcggtgaaatgcgcagatatcaggaggaacaccaatggcgaaggcaggtctctgggctgtaactgacgctgagaagcgaaagcatggggagcaaacaggattagataccctggtagtccatgccgtaaacgttgggcactaggtgtgggggacattccacgttttccgcgccgtagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatatactggaccgctctagagatagagtttcccttcggggctggtatacaggtggtgcatggttgtcgtcagctcgtgtcgtgagatgttgggttaagtcccgcaacgagcgcaaccctcgttctatgttgccagcacgtaatggtggggactcataggagactgccggggtcaactcggaggaaggtggggatgacgtcaaatcatcatgccccttatgtcttgggcttcacgcatgctacaatggccggtacaaagggttgcgatactgtgaggttgagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccccttgtgggagggagtcgtcgaaggtgggattggcgattgggactaagtcgtaacaaggtagccgtaccggaagg

SEQ ID NO: 1653 - DNA, 1500 bp, Rothia sp.
  oral taxon 188
gagtttgatcctggctcaggacgaacgctggcggcgtgcttaacacatgcaagtcgaacgatgaagcggtgcttgcaccgtggattagtggcgaacgggtgagtaatacgtgagtgacctacctttgactctgggataagcctgggaaactgggtctaataccggatacgaccaatctctgcatggggtgttggtggaaagcgttatggagtggttttagatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcatcgaagaagcgaaagtgacggtaggtgcagagaaagcgccggctaactacgtgccagcagccgcggtaatacgtagggcgcgagcgttgtccggaattattgggcgtaaagagcttgtaggcggttggtcgcgtctgctgtgaaaggccggggcttaactccggttttgcagtgggtacgggctaactagagtgcagtaggggagactggaattcctggtgtagcggtggaatgcacagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcattagatcgcgtcagagatggcgtttcccttcggggctggtgtacaggtggtgcatggttgtcgtcagctcgtgtcgtgagatgttgggttaagtcccgcaacgagcgcaaccctcgttctatgttgccagcggttcggccggggactcataggagactgccggggttaactcggaggaaggtggggatgacgtcaaatcatcatgccccttatgtcttgggcttcacgcatgctacaatggccggtacagagggttgcgatactgtgaggtggagctaatcccttaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggattggcgattgggactaagtcgtaacaaggtagccgtaccggaaggtgc

SEQ ID NO: 1654 - DNA, 1539 bp, Ruminobacter amylophilus
aaagtgaagagtttgatcatggctcagattgaacgctggcggcaggcttaatacatgcaagtcgaacggtaacagcaggaagcttgcttcctggctgacgagtggcggacgggtgagtaatacctggggagctgcctgaatgagggggacaacacctggaaacgggtgctaataccgcgtaagcctgagggggaaaggctgggcaaccagtcgcattcagatgcgcccaggtgggattagctagttggtggggtaacggcctaccaaggcgacgatctctagctggtctgagaggatgatcagccacactggaactgagacacggtccagactcctacgggaggcagcagtagggaatattgcacaatgggggaaaccctgatgcagccatgccgcgtgtgtgaagaaggcctttgggttgtaaagcactttcagtatggaggaagtgtagtatgttaacagcatgctgcattgacgttacatacagaagaagcaccggctaactccgtgccagcagccgcggtaatacggagggtgcgagcgttaatcggaataactgggcgtaaagagctcgtaggcggtttgtcaagtcagatgtgaaagccccgggcttaacctgggaaccgcatttgaaactgacagactagagtactgtagagggaggtagaattccaggtgtagcggtgaaatgcgtagatatctggaggaataccggtggcgaaggcggcctcctggacagagactgacgctgaggagcgaaagcgtggggagcaaacaggattagataccctggtagtccacgccgtaaacgatgtcaattagaagcatgttgccatgagtagtgtgtttctaagctaacgcgataaattgaccgcctggggagtacggccggcaaggttaaaactcaaatgaattgacgggggcccgcacaagcggtggagcatgtggtttaattcgatgcaacgcgaagaaccttacctggacttgacatattgagaagtatttagagatagatacgtgccgcaaggagctcaaatacaggtgctgcatggctgtcgtcagctcgtgtcgtgagatgttgggttaagtcccgcaacgagcgcaacccttgttctttgttgccagcacgtaaaggtgggaactcaaagaagactgccggtgacaaaccggaggaaggcagggatgacgtcaagtcatcatggcccttacgtccagggctacacacgtgctacaatgggttgtacagagggaagcgaagtcgcgaggtagagcggaacccagaaagcaactcgtagtccggattggagtctgcaactcgactccatgaagtcggaatcgctagtaatcgcgaatcagaatgtcgcggtgaatacgttcccgggccttgtacacaccgcccgtcacaccatgggagtgaattgcaccagaagtagttagcttaacccgcaagggagggcgattaccacggtgtggtttatgactggggtgaagtcgtaacaaggtaaccataggggaacctgtggttggatcacctcctta

SEQ ID NO: 1655 - DNA, 1014 bp, Ruminococcaceae bacterium D16
  modified_base (907)..(907): a, c, t, g, unknown or other
  modified_base (910)..(910): a, c, t, g, unknown or other
  modified_base (953)..(955): a, c, t, g, unknown or other
  modified_base (973)..(973): a, c, t, g, unknown or other
  modified_base (980)..(981): a, c, t, g, unknown or other
  modified_base (996)..(996): a, c, t, g, unknown or other
  modified_base (1002)..(1002): a, c, t, g, unknown or other
tgcctttgaagaggattcgtccaattgataaggttacttagtggcggacgggtgagtaacgcgtgaggaacctgccttggagtggggaataacacagtgaaaattgtgctaataccgcataatgcagttgggtcgcatgactctgactgccaaagatttatcgctctgagatggcctcgcgtctgattagctagttggtggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttcttagggacgaagcaagtgacggtacctaaggaataagccacggctaactacgtgccagcagccgcggtaatacgtaggtggcaagcgttatccggatttactgggtgtaaagggcgtgtaggcgggattgcaagtcagatgtgaaaaccacgggctcaacctgtggcctgcatttgaaactgtagttcttgagtactggagaggcagacggaattcctagtgtagcggtgaaatgcgtagatattaggaggaacaccagtggcgaaggcggtctgctggacagcaactgacgctgaggcgcgaaagcgtggggagcaaacaggattagataccctggtagtccacgctgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccnggnttgacatcccgaggtccggtctagagatagacctttctcttcnnnacctcggtgacaggtggngcatggnngtcgtcagctcgtgncgtganatgttgggttaa

SEQ ID NO: 1656 - DNA, 1503 bp, Ruminococcus albus
agagtttgatcctggctcaggacgaacgctggcggcacgcttaacacatgcaagtcgaacgagcgaaagagtgcttgcactctctagctagtggcggacgggtgagtaacacgtgagcaatctgcctttcggagagggataccaattggaaacgattgttaatacctcataacataacgaagccgcatgactttgttatcaaatgaatttcgccgaaagatgagctcgcgtctgattaggtagttggtgaggtaacggcccaccaagccgacgatcagtagccggactgagaggttgaacggccacattgggactgagacacggcccagactcctacgggaggcagcagtggggaatattgcacaatgggcgaaagcctgatgcagcgatgccgcgtgagggaagaaggttttaggattgtaaacctctgtctttggggacgataatgacggtacccaaggaggaagctccggctaactacgtgccagcagccgcggtaatacgtagggagcgagcgttgtccggaattactgggtgtaaagggagcgtaggcgggattgcaagtcaggtgtgaaatttaggggcttaacccctgaactgcacttgaaactgtagttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggctgaaactcaaaggaattgacgggggcccgcacaagcagtggagtatgtggtttaattcgaagcaacgcgaagaaccttaccaggtcttgacatcgtacgcatagcatagagatatgtgaaatcccttcggggacgtatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggctacacacgtactacaatggctgttaacagagggaagcaaaacagtgatgtggagcaaaaccctaaaagcagtcttagttcggattgtaggctgcaacccgcctacatgaagtcggaattgctagtaatcgcggatcagcatgccgcggtgaatacgttcccgggccttgtacacaccgcccgtcacgccatgggagtcggtaacacccgaagcctgtgttctaaccgcaaggaggaagcagtcgaaggtgggattgatgactggggtgaagtcgtaacaaggtagccgtatcggaaggtgcggctggatcacctcctt

SEQ ID NO: 1657 - DNA, 1391 bp, Ruminococcus bromii
  modified_base (21)..(21): a, c, t, g, unknown or other
tcgaacggaacttctttaaanggatttcttcggaatgaatttgattaagtttagtggcggacgggtgagtaacgcgtgagtaacctgcctctaagaggggaataacattctgaaaagaatgctaataccgcataatatatatttatcgcatggtagatatatcaaagatttatcgcttagagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggaaaccctgacgcagcaacgccgcgtgaaggatgaaggtcttcggattgtaaacttcttttattaaggacgaagaaagtgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccatagcctgcatttgaaactgcagagcttgagtgaagtagaggcaggcggaattccccgtgtagcggtgaaatgcgtagagatggggaggaacaccagtggcgaaggcggcctgctgggctttaactgacgctgagcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtgggtatgtggtttaattcgaagcaacgcgaagaaccttaccaggtcttgacatcctactaacgagatagagatatgttataggccgtttgggaaaagtagagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggacattaacagagggaagcaatacagtgatgtggagcaaacccctaaaaatgttctcagttcagattgcaggctgcaacccgcctgtatgaagatggaattgctagtaatcgcagatcagcatgctgcggtgaatacgttcccgggccttgtacacaccgcccgtcacaccatgggagccggtaatacccgaagtcagtagtctaaccgcaaggaggacgct

SEQ ID NO: 1658 - DNA, 1371 bp, Ruminococcus callidus
ttaacacatgcaagtcgaacggagaacattgagcttgcttaatgttcttagtggcggacgggtgagtaacacgtgagtaacctgcctctgagagtgggatagcttctggaaacggatggtaataccgcataacatcatggattcgcatgtttctgtgatcaaagatttatcgcttagagatggactcgcgtctgattagctagttggtaaggtaacggcttaccaaggcgacgatcagtagccggactgagaggttgatcggccacattgggactgagacacggcccagactcctacgggaggcagcagtggggaatattgcacaatgggggaaaccctgatgcagcgatgccgcgtggaggaagaaggttttcggattgtaaactcctgttgaagaggacgataatgacggtactcttttagaaagctccggctaactacgtgccagcagccgcggtaatacgtagggagcgagcgttgtccggaattactgggtgtaaagggagcgtaggcgggatggcaagtcagatgtgaaaactatgggctcaacccatagactgcatttgaaactgttgttcttgagtgaggtagaggtaagcggaattcctggtgtagcggtgaaatgcgtagagatcaggaggaacatcggtggcgaaggcggcttactgggcctttactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcgagtgacgtacctagagataggtattttcttcggaacacaaagacaggtggtgcatggttgtcgtcagctcgtgtcgtgagatgttgggttaagtcccgcaacgagcgcaacccttaccattagttgctacgcaagagcactctaatgggactgccgttgacaaaacggaggaaggtggggatgacgtcaaatcatcatgccccttatgacctgggctacacacgtactacaatggcaatataacagagggaagcaatacagcgatgtggagcaaatccccaaaaattgtcccagttcagattgcaggctgcaactcgcctgcatgaagtcggaattgctagtaatcgcagatcagcatgctgcggtgaatacgttcccgggccttgtacacaccgcccgtcacaccatgggagtcggtaacacccaaagccggtcgtctaacctt

SEQ ID NO: 1659 - DNA, 1494 bp, Ruminococcus champanellensis
agagtttgatcctggctcaggacgaacgctggcggcacgcctaacacatgcaagtcgaacggagataaagacttcggtttttatcttagtggcggacgggtgagtaacacgtgagcaacctgcctctgagagagggatagcttctggaaacggatggtaatacctcataacatagcggtaccgcatgatactgctatcaaagatttatcgctcagagatgggctcgcgtctgattagctagatggtgaggtaacggctcaccatggcgacgatcagtagccggactgagaggttgaacggccacattgggactgagacacggcccagactcctacgggaggcagcagtggggaatattgcacaatgggcgcaagcctgatgcagcgatgccgcgtggaggaagaaggttttcggattgtaaactcctgtcttaagggacgataatgacggtaccttaggaggaagctccggctaactacgtgccagcagccgcggtaatacgtagggagcgagcgttgtccggaattactgggtgtaaagggagcgtaggcgggattgcaagtcagatgtgaaaactatgggcttaacccatagactgcatttgaaactgtagttcttgagtgaagtagaggtaagcggaattcctagtgtagcggtgaaatgcgtagatattaggaggaacatcggtggcgaaggcggcttactgggcttttactgacgctgaggctcgaaagcgtggggagcaaacaggattagataccctggtagtccacgctgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaaaaaccttaccaggtcttgacatcgagtgaatgatctagagatagatcagtccttcgggacacaaagacaggtggtgcatggttgtcgtcagctcgtgtcgtgagatgttgggttaagtcccgcaacgagcgcaacccttacctttagttgctacgcaagagcactctagagggactgccgttgacaaaacggaggaaggtggggatgacgtcaaatcatcatgccccttatgacctgggctacacacgtactacaatggcaatgaacagagggaagcaatacagtgatgtggagcaaatccccaaaaattgtcccagttcagattgtaggctgcaactcgcctacatgaagtcggaattgctagtaatcgcagatcagcatgctgcggtgaatacgttcccgggccttgtacacaccgcccgtcacaccatgggagtcggtaacacccgaagccagtagcctaaccgcaaggagggcgctgtcgaaggtgggattgatgactggggtgaagtcgtaacaaggtagccgtatcggaaggtgcggctggatcacct

SEQ ID NO: 1660 - DNA, 1388 bp, Ruminococcus flavefaciens
  modified_base (157)..(157): a, c, t, g, unknown or other
  modified_base (276)..(276): a, c, t, g, unknown or other
gctggcggcacgcttaacacatgcaagtcgaacggagataatttgagtttacttaggttatcttagtggcggacgggtgagtaacacgtgagcaacctaccttagagagagggatagcttctggaaacggatggtaatacctcataacataactganccgcatgatttagttatcaaagatttatcactctgagatgggctcgcgtctgattagatagttggtgaggtaacggctcaccaagtcgacgatcagtagccggactgagaggttgaacngccacattgggactgagacacggcccagactcctacgggaggcagcagtggggaatattgcacaatgggggaaaccctgatgcagcgatgccgcgtggaggaagaaggttttcggattgtaaactcctgtcttaaaggacgataatgacggtactttaggaggaagctccggctaactacgtgccagcagccgcggtaatacgtagggagcgagcgttgtccggaattactgggtgtaaagggagcgtaggcgggagcgcaagtcagatgtgaaatacatgggctcaacccatgggctgcatttgaaactgtgtttcttgagtgaagtagaggtaagcggaattcctggtgtagcggtgaaatgcgtagatatcaggaggaacaccggtggcgaaggcggcttactgggcttttactgacgctgaggctcgaaagcgtggggagcaaacaggattagataccctggtagtccacgctgtaaacgatgattactaggtgtggggggactgaccccttccgtgccgcagttaacacaataagtaatccacctggggagtacgsccscaaggttgaaactcaaaggaattgacgggggcccgcacaagcagtggagtatgtggtttaattcgaagcaacgcgaagaaccttaccaggtcttgacatcgtatgcatagtctagagatagatgaaattccttcggggacatatagacaggtggtgcatggttgtcgtcagctcgtgtcgtgagatgttgggttaagtcccgcaacgagcgcaacccttacctttagttgctacgcaagagcactctaaagggactgccgttgacamaacggaggaaggtggggatgacgtcaaatcatcatgccccttatgacctgggctacacacgtactacaatggcaattaacaaagagaagcaagacggtgacgtggagcgaatctcaccaaattgtcccagttcagattgcaggctgcaactcgcctgcatgaagtcggaattgctagtaatcgcggatcagcatgccgcggtgaatacgttcccgggccttgtacacaccgcccgtcacaccatgggagtcggtaacacccgaagtcggtagtctaacagc

SEQ ID NO: 1661 - DNA, 1392 bp, Ruminococcus gnavus
  modified_base (1378)..(1380): a, c, t, g, unknown or other
gtcgagcgaagcacttttgcggatttcttcggattgaagcaattgtgactgagcggcggacgggtgagtaacgcgtgggtaacctgcctcatacagggggataacagttggaaacggctgctaataccgcataagcgcacagtaccgcatggtaccgtgtgaaaaactccggtggtatgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaagcccggggctcaaccccgggactgcatttggaactgtcaggctagagtgtcggagaggaaagcggaattcctagtgtagcggtgaaatgcgtagatattaggaggaacaccagtggcgaaggcggctttctggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggatccgcacaagcggtggagcatgtggtttaattcgaagcaacgcgaagaaccttacctggtcttgacatccctctgaccgctctttaatcggagctttccttcgggacagaggagacaggtggtgcatggttgtcgtcagctcgtgtcgtgagatgttgggttaagtcccgcaacgagcgcaacccctatctttagtagccagcatttaagatgggcactctagagagactgccagggataacctggaggaaggtggggatgacgtcaaatcatcatgccccttatgaccagggctacacacgtgctacaatggcgtaaacaaagggaagcgagcccgcgagggggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaacnnnaaggagggagct

SEQ ID NO: 1662 - DNA, 1373 bp, Ruminococcus hansenii
tatcattgactcttcggaagatttgatatttgactgagcggcggacgggtgagtaacgcgtgggtaacctgcctcatacaggggaataacagttagaaatggctgctaatgccgcataagcgcacaggaccgcatggtctggtgtgaaaaactgaggtggtatgagatggacccgcgtctgattaggtagttggtggggtaacggcctaccaagccgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaagacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggtgcaaagcagttcggtgccgcagcaaacgcaataagtattccacctggggagtacgttcgcaagaatgaaactcaaaggaattgacggggacccgcacaagcggtggagcatgtggtttaattcgaagcaacgcgaagaatcttaccaagtcttgacatctgcctgaccgtcccttaaccggagctttccttcgggacaggcaagacaggtggtgcatggttgtcgtcagctcgtgtcgtgagatgttgggttaagtcccgcaacgagcgcaacccctatccttagtagccagcagtccggctgggcactctagggagactgccggggataacccggaggaaggcggggacgacgtcaaatcatcatgccccttatgatttgggctacacacgtgctacaatggcgtaaacaaagggaagcgaagcggtgacgcttagcaaatctcaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttatggaggga

(The sequence listing continues in the following parts.)

What is claimed is:

1. A composition consisting essentially of:
a bacterial population consisting of from seven to nine purified bacterial strains, wherein two of the bacterial strains are *Clostridium innocuuin* and *Blautia producta*; and
a capsule substantially encapsulating the bacterial population;
wherein the bacterial strains are present in the composition in an amount effective to treat a *C. difficile* infection in a mammalian subject.

2. The composition of claim 1, wherein each bacterial strain is purified by selecting its colony from a plate of single colonies and re-streaking the colony on solid media at least three times.

3. The composition of claim 2, wherein at least three of the bacterial strains are not present in the composition in equal ratios.

4. The composition of claim 2, wherein at least one of the bacterial strains is provided in a concentration of greater than $1)(10^9$ viable bacteria per gram of the composition.

5. The composition of claim 2, wherein the bacterial strains are present at a concentration of at least $1 \times 10^4$ viable bacteria.

6. The composition of claim 1, wherein the bacterial strains are substantially encapsulated in an enteric coating.

7. The composition of claim 1, wherein upon oral administration to a mammal having a *C. difficile* infection, the composition reduces *C. difficile* associated weight loss compared to a control composition not containing the bacterial strains.

8. The composition of claim 1, wherein upon oral administration to a mammal having a *C. difficile* infection, the composition reduces *C. difficile* associated mortality compared to a control composition not containing the bacterial strains.

9. The composition of claim 1, wherein upon oral administration to a mammal having a *C. difficile* infection, the composition improves the clinical score compared to a mammal not receiving administration of the composition.

10. The composition of claim 1, wherein the composition has a mortality score of equal to or less than 1.5 when tested in a mouse model.

11. The composition of claim 1, wherein the composition as a mortality score of equal to or less than 1 when tested in a mouse model.

12. The composition of claim 1, wherein the composition has a weight score of equal to or less than 1.5 when tested in a mouse model.

13. The composition of claim 1, wherein the composition has a weight score of equal to or less than 1 when tested in a mouse model.

14. The composition of claim 2, wherein the composition has a summary score of a mortality score, a weight score, and a clinical score of equal to or less than 4 when tested in a mouse model.

15. The composition of claim 2, wherein the composition has a summary score of a mortality score, a weight score, and a clinical score of equal to or less than 2 when tested in a mouse model.

16. The composition of claim 2, wherein the bacterial population consists of seven purified bacterial strains.

17. The composition of claim 2, wherein the bacterial population consists of eight purified bacterial strains.

18. The composition of claim 2, wherein the bacterial population consists of nine purified bacterial strains.

19. The composition of claim 2, further consisting essentially of an excipient.

* * * * *

UNITED STATES PATENT AND TRADEMARK OFFICE
CERTIFICATE OF CORRECTION

PATENT NO. : 10,973,861 B2  
APPLICATION NO. : 14/765812  
DATED : April 13, 2021  
INVENTOR(S) : Afeyan et al.

Page 1 of 1

It is certified that error appears in the above-identified patent and that said Letters Patent is hereby corrected as shown below:

In the Specification

In Column 2, Line 53, delete "$1\times10^2$" and insert -- $1\times10^9$ --, therefor.

In the Claims

In Column 153, Claim 1, Line 30, delete "innocuuin" and insert -- innocuum --, therefor.

In Column 153, Claim 3, Line 40, delete "claim 2," and insert -- claim 1, --, therefor.

In Column 153, Claim 4, Line 43, delete "claim 2," and insert -- claim 1, --, therefor.

In Column 153, Claim 4, Line 45, delete "1)($10^9$" and insert -- $1\times10^9$ --, therefor.

In Column 153, Claim 5, Line 46, delete "claim 2," and insert -- claim 1, --, therefor.

In Column 154, Claim 11, Line 35, delete "as" and insert -- has --, therefor.

In Column 154, Claim 14, Line 43, delete "claim 2," and insert -- claim 1, --, therefor.

In Column 154, Claim 15, Line 47, delete "claim 2," and insert -- claim 1, --, therefor.

In Column 154, Claim 16, Line 51, delete "claim 2," and insert -- claim 1, --, therefor.

In Column 154, Claim 17, Line 54, delete "claim 2," and insert -- claim 1, --, therefor.

In Column 154, Claim 18, Line 56, delete "claim 2," and insert -- claim 1, --, therefor.

In Column 154, Claim 19, Line 58, delete "claim 2," and insert -- claim 1, --, therefor.

Signed and Sealed this  
Sixteenth Day of November, 2021

Drew Hirshfeld  
*Performing the Functions and Duties of the  
Under Secretary of Commerce for Intellectual Property and  
Director of the United States Patent and Trademark Office*